United States Patent 8,071,732 (COMPOSITIONS AND METHODS FOR THE DETECTION, DIAGNOSIS AND THERAPY OF HEMATOLOGICAL MALIGNANCIES) - sequence listing, part 2

SEQ ID NO: 8182 - DNA, 593 bp, Homo sapiens
ctgccaggagccagttgctctggcctcagtctccaattgttagtctcaggatcaacagagaactggaaagcagcagaatctggaggagcaggaagagagcccagagggagtgttgtgctgagtgacggttaacagatgaaacagaatttcatggagattctttgttacaaggagaaattgctcagtctcaactcccaaaacgtgaaagttgcctggtttaagagacctatgttttctttttcagctcttcaaacctccgggaaagatcatcaaagtcaatgtcttcagatgctgaggtgctggcaccagcagatgcagttggtagtgtgtctggcacagatggcaactctggtaggacaaagttgtcatagttatctgcaggtctggaaggaagctttgcagaggcttctggcttgggtccaggaccaacaatctgtgcagaagagatattcttatcagcattaatgtcatctacctgaaacacaaagattgttaccagaggagacagcaatagtgtcactggagaaagtactggtgtaagcccctgtgtttccaaaagttaagttgctcaccaaatgcaacagagcctgttc

SEQ ID NO: 8183 - DNA, 357 bp, Homo sapiens
ccacatcaatgtcatacagcttcttcacagcctgtttaatctggtgcttgttggctttaacatccacaatgaacacaagtgtgttgttgtcttctatcttcttcatggcagactcagtggtcagcggaaacttgatgatagcatagtggtcaagcttgtttctcctgggagcgctcttccgaggatatttgggctgtctccggagtcgcagtgtcttcggccgccggaaggtgggtgacgtgcggatcttcttctttttgtggctgtggacacctttcaacactgccttcttggcctttaaagccttcgctttggcttcagctttaggaggggcaggagcttccttcttcgctttcg

SEQ ID NO: 8184 - DNA, 595 bp, Homo sapiens
ccaatatgcctttggagcacagcctatggtttatgtttcttttatgaccacctttaatatctgtcaaacgactagacatgctatagctttacccgaaggtaatttgattgactgtgctctgctagaagatggtgtatgggtccctctcgaggtaactgccaataaatgataagtggtatttgttttagataatgcctctacctcagtggtagctttgataatggcaaattgtaattgcaagtgccattttcagaataggcattggtttattttaggaagaggataataaagttccttttagttatcaaagtaacaccttttattgttaaatctcaacttttgaagaaaacactttcaatttcttaactttttcctcagggttagtgagttagtacaactacccaaagaagtgttaaaatattgagattctatatgtgtgtgtttatatgtgcatctatgtattacgtatacaaaatatttcacctcaaaggactttttgaaaaggtaatctttggtctatagtacagtgttaagctcactgataatttagaatcattaagttcgtttattttcttaacactacagaaaggaaagg

SEQ ID NO: 8185 - DNA, 514 bp, Homo sapiens
  misc_feature (1)...(514): n = g, a, c or t
ccaggatggcatcagtggcaaacacattcccctgagtttttgccagcttgcggatgacagggtcgtctgtggtggtgacagtgtggaagatgcgcttgatgctccgcagtggcttctcactcctcgtggtgatgcggtcaaaggctttgtcgtagtattctagggccccacaacactcaatgtcctgtggctctgatacttccaagtagcgcatcttcatcaactgaggaaaatccatttcctctttcacttcccaatcactacgaacttcaactgaagagtctcggggtttctgtgatttctgatcccatttctgcctaaccccaaattgtttctggaactttttctgcagtcgaatgcgttctctctctttctgtttggcactcttaggcaggatctgcangttgaactgcaacatgttccgacgatctttgtctctgcggaggttcctctgggcaaatctcattcgattccgctggtaggccgtcttctgtgtgcgcgctgtatccaccag

SEQ ID NO: 8186 - DNA, 601 bp, Homo sapiens
  misc_feature (1)...(601): n = g, a, c or t
gttatttccaccatctggttttccaatgctagtcactgacatcaagccaagactgagaaaatttgcccacatctctggaggtacaaccaccccatatttgggtcagtcctgatctctgatgccttcttcccctttctccactgacctttcagagaggttaaatggatttgacagagaaagcatacagactgttcaaaaatggaagatcatctactaagattatatccatctctaagactttacatgtttatgatttcactaactatgcatcccaattttgtgaatatatttttaaagaaacatttatatctatatcaattactaaaagccaacatttattggagctctttaattgtattaaaatttattatccatgataatgcaatacaactgatactgtttttagtttaatatgtgtagttaacgaacctcagaggggttaacttgcctgctgtcacacaatggaaacctcaatttgaaagtttgccctaagccactaaactatgctacttatcccttcagcacatacatgacatccttatttactcatctaaaagttatggttagagttgagaggtagtgttataatccanaaagagca

SEQ ID NO: 8187 - DNA, 361 bp, Homo sapiens
ccaagcatctaagaatataatccagccaccctcctgtgttttgcattattataatgttccattgtgtgtcacagaagagaccttcacaaagttgtgtaatgaccatgaagttcttacattcatcaaatataaagtgtttgatgcaaaaccttcagccaaaacactttctgggctattagaatgggagtccaaaactgatgcagtagaagcccttacggcactgaatcactatcagataagagtgccgaatggttccaatccctatacattgaagctttgcttttctacatcatcccatttataagaagagaagagcatgttagaatttatgttcacctttattacaaatgggatgatgtag

SEQ ID NO: 8188 - DNA, 363 bp, Homo sapiens
cctggcatacccccatcctctacactcatacccacacaagaccctgggtggctaaggggcagcagggattgcaacacgtttggggaaaatcaagttatggagccagctcccaggaaggagaagccgtggaacattgccagagagaatactgaggatcagaggcatctaccaactccacagtcagggcttgaagagtaaggggctggtggtccttgaagccacagtcttggggcgagtcccatggagctaggaaggggaagaaggaatccagggtgcaggctgaggaactactgtccacaatctgcaggaagggaggcaaggatgaaggtggcaggaaagttggagatagcaaatggatgacag

SEQ ID NO: 8189 - DNA, 387 bp, Homo sapiens
ccatcggtgctgaaattgagcattttaaatagtacagtaggctggtatacattaggaaatggactgcactggaggcaaatagaaaactaaagaaattagataggctggaaatgcttactttctgctctcattttctttcattttgtctgctgtctttttgaatgccaatactttcatttaaaatgttttgggagcacggcaacccaaaatgactgaacggtggtccaaaaatccaaaccaactgataattacttctcgaggtgataggaaaggcacaggaagttaggactttggctgaaatgatgaaaacacatgttcgccattttagggatcagcgcctcgactcctgccacctccggctccaacgatgatcagcaaaggacaatt

SEQ ID NO: 8190 - DNA, 537 bp, Homo sapiens
  misc_feature (1)...(537): n = g, a, c or t
caaatagcaaaattgaggccaagggccaagagaatatccgaactttaatttcaggaattgaatgggtttgctagaatgtgatatttgaagcatcacataaaaatgatgggacaataaattttgccataaagtcaaatttagctggaaatcctggatttttttctgttaaatctggcaaccctagtctgctagccaggatccacaagtccttgttccactgtgccttggtttctcctttatttctaagtggaaaaagtattagccaccatcttacctcacagtgatgttgtgaggacatgtggaagcactttaagttttttcatcataacataaattattttcaagtgtaacttattaacctatttattatttatgtatttatttaagcatcaaatatttgtgcaangaatttggaaaaatagaagatgaatcattgattgaatagttataaagatgttatagtaaatttattttattttagatattaaatgatgttttattagataaatttcaatcagggtttttagattaaacaaa

SEQ ID NO: 8191 - DNA, 599 bp, Homo sapiens
ctgatcttaaactcctgacctcaagcagtctacccccgttggcctcccaaagtgctgggattacaggtgtgagccactgcacccagccaagtttatgtatttttattctttttcatgaatgtgatttgttaaatgagtgattaaatataatttttatatatttgtatgacttttctgtaaataaaatttaaaatcagaaaaaatcatgttagaccatgtatagtgatttattttgaaattttgattatttaatatgtacaccatgctctgttcttccccacaataaaaaaattcaatgctttgtcttctttaaaatataccatataaatagcatcagtaatagtaaatatcgaggaatgactctaataaaatatgtacagtacttctgcatggaattctataaaacattattgagagaaactaaagaagacccaaataattggagcattatataatgttcatgtattgaaagaatcaatattataaacatacatgttttctccaaatctatagatcccaatttaatcccaatcaaaatcttaataacagcattattaaaaataacattattgagatataattcacatatcttaaaattc

SEQ ID NO: 8192 - DNA, 301 bp, Homo sapiens
  misc_feature (1)...(301): n = g, a, c or t
atgtaaataagatgatttaatgttgattttaatcctgtatataaaataaaaagtcacaatgagtttgggcatatttaatgatgattatggagccttagaggtctttaatcattggttcggctgcttttatgtagtttaggctggaaatggtttcacttgctctttgactgtcagcaagactgaagatggcttttcctggacagctagaaaacacaaaatcttgtaggtcattgcacctatctcagccataggtgcagtttgcttnctacatgatgctaaaggctgcgaatgggatcctgat

SEQ ID NO: 8193 - DNA, 563 bp, Homo sapiens
ctggcaatgacaagactgggagtatcaaactaggattgttagttcaattaaaatttcagataaacaataatgtacttatactaaaaaattatttgttgtttatctgaaatgaaaatttaactgggtacccaattgtttgtttgtttaatctaaaaaccctgattgaaatttatctaataaaacatcatttaatatctaaaataaaataaatttactataacatctttataactattcaatcaatgattcatcttctatttttccaaattcttgcacaaatatttgatgcttaaataaatacataaataataaataggttaataagttacacttgaaaataatttatgttatgatgaaaaaacttaaagtgcttccacatgtcctcacaacatcactgtgaggtaagatggtggctaatactttttccacttagaaataaaggagaaaccaaggcacagtggaacaaggacttgtggatcctggctagcagactagggttgccagatttaacagaaaaaaatccaggatttccagctaaatttgactttatggcaaaatttatt

SEQ ID NO: 8194 - DNA, 571 bp, Homo sapiens
  misc_feature (1)...(571): n = g, a, c or t
gtttaacggccgcggtaccctaaccgtgcaaaggtagcataatcacttgttccttaattagggacctgtatgaatggctccacgagggttcagcctgtttgattgtagctatgttggtgtatctcgtgtacaagatggaaaagtgcttttgttgttctacctgatccagttgggggagcaggaatagggggtgcctgcctaacggcctctagcccatgtgcttatactgggatctgtcccgagggatctgcacctggttggcagtcattttgtggtggatgtggtaaatcgcgagtgttaccatgatgacgaggcccaagatgagccccaaaatcaggggcaaggtttcttccagttgctcccgctcatccactgggcatttatgctcttcactgaagacaaaatctgagataatgtcaaaaggttggatgtggaccgcagacaggatcatggtgaccgtcttctgcggatcactagaggccagtgaaatggtttgttgagcttgacactcataggacttcccagcgggggtgaccaaggcaganaggtggtgcgagttggctgtgtgctt

SEQ ID NO: 8195 - DNA, 511 bp, Homo sapiens
  misc_feature (1)...(511): n = g, a, c or t
atttcaagaacactgaanaatggaaagtgggcattaactgaagcagacacctcttgaggtaagatttgtggaagaagaggttaaagngtgccagaaatttgggttaccctcctctagaaagaaattccagtaatggatctgtttaagtgttaagggagcanangagaagacggtgaatgtacttcaatattttgaacatttttngaaataggaattcttgagtctcttttctttcttcagtcttttccatttctttttcttttctttttcactgtaatnntctgtgtttctgatactgtgctgntttagataatattatgtttacatctttcatcccactccttatnccttcaaaggtctgaggaaaaaaaacctgtcccctggtgcggnggaatcggatgtgagaggaataactggggttgatctatttggaactacagatgcagtggtgaagcatgtactanagggtcacgatcgtggagtaaactgggctgccttccaccccactatg

SEQ ID NO: 8196 - DNA, 563 bp, Homo sapiens
  misc_feature (1)...(563): n = g, a, c or t
ccagtggaatgatgttccctgcaattaccatctcacctatacgtgcaagaaaggaacagttgcttgcggccagccccctgttgtagaaaatgccaagacctttggaaagatgaaacctcgttatgaaatcaactccctgattagataccactgcaaagatggtttcattcaacgtcaccttccaactatccggtgcttaggaaatggaagatgggctatacctaaaattacctgcatgaaccgtaagtggtcctttagaaagaatggactaccgtgctataacaactactagacaccttcattttacggctgtggtatcggcagtttagggtatggagcaagtaatattgtgtgttttctttttttctttctttccttccatgtagcatctgcataccaaaggacttattctatgaaatactttaaaaattcctcatcagcaaaggacaattcaataaatacatccaaacatgatcatcgttggagccggaggtggcaggagtcgaggcgctgatccctnaaatggcgaacatgtgttttcatcatttcagccaaagtcctaa

SEQ ID NO: 8197 - DNA, 562 bp, Homo sapiens
  misc_feature (1)...(562): n = g, a, c or t
ccttcttgtgatcttgctctatctcacagcacactcagcacccccttctctgcccattccccagcctctcttcctatcccatcccatcccatcccatcccatcccatcccgctcttttcctacttttccttccctcaaagcttccattccacatccggaggagaagaaggaaatgaatttctctacagatgtcccattttcagactgctttaaaaaaaatccttctaatctgctatgcttgaatgccacgcggtacaaaggaaaaagtatcatggaaatattatgcaaattcccagatttgaagacaaaaatactctaattctaaccagagcaagcttttttattttttatacaggggaatattttattcaaggtaaaattctaaataaaatataattgttttttatcttttctacagcaaatttataattttaagattccttttcttgtttatcagcagttgttattacatccttgtggcacatttttttttttaattttgtaaaggngaaaaaagcttttatgagctcatgtagcaatcagattttcctgnggatngata

SEQ ID NO: 8198 - DNA, 547 bp, Homo sapiens
  misc_feature (1)...(547): n = g, a, c or t
tttttttttggaaattggagataaaatttttattacttgtaaacaaaattctgtcaaaaacctgacaaattaaacaatacaattaatatgtttaatagaactaattacatatgagaggcatccaaaatccatttttctatacaaacatggtttgatatacagtcattttatctgtgtattaattggtttatgaaataacaaatagaaaaatcaagtatgcattatcaagttaaagaagcaggagagatggagctataaaaacaaagagagaagaatgttgtaaggagggcttaacaaccaggataaatgttgtagagagatcaattaaagtgatggcctanagatcacgggcttcctttggcagagccatgttggtgaagtgaaggaagtggaagccagaccacaatggttgaagaatgaatgtaatgtaagagccaagacatttatttgagtctgatagtaatgaaaaaggacaagaattttcttcttgctgttgtttttgncatttcatgttcaaaaccctttatctcccatgtggtactgaaaa

SEQ ID NO: 8199 - DNA, 592 bp, Homo sapiens
  misc_feature (1)...(592): n = g, a, c or t
ggcagatagtgagcgctggtggcggagttaaagtcaaagcaggagagtaattatgaatagcgcagcgggattctcacacctagaccgtcgcgagcgggttctcaagttangggagagtttcgagaagcagncgcgctgcgccttccacactgngcgctatgacttcaaacctgcttctattgacacttcttctgaaggataccttgaggttggtgaaggtgaacaggtgaccataactctgccaaatatagaaggttcaactccaccagtaactgttttcaaaggttcaaaaaaaccttacttaaaagaatgcattttgattattaaccatgatactggagaatgtcggctagaaaaactcagcagcaacatcactgtaaaaaaaacaagagttgaaggaagcagtaaaattcagtatcgtaaagaacaacagcaacaacaaatgtggaattcagccaggactcccaatcttgtaaaacattctccatctgaagataagatgtccccagcatctccaatagatgatatcgaaagagaactgaaggcangaagctagtctaatggaccagatgagtagttgtgatagttcatc

SEQ ID NO: 8200 - DNA, 542 bp, Homo sapiens
ccaccttttaaacataagttaattacttgctgacataatatgaaaccttactttaaatacaatagtttcaaagaaaaatggtgttacaatataaaaccacaacaaaaggtgtgcaaagagacatttatattggctataaaaggcagtgagaggaaagggcaaagcagtttagaaaataattcctgcaatcactatttacagttctggtttgagctttgtttgaattccacttgaaaaaataactcccttcaaccaactgactcagggggatggatggaaaagaacagagtaggtgaaatttgcaacaaactgactctaagaaggctctcaccttagagatattaacttggatcaggcgcatctttctctgtgattgcatattgaaggagtgctgtctaaagcccttgatcctctgtctctcttccttcactcagtgcattggtgcagcaattttgtttattcccgtttccaaatgccacacccttctgtgagcagagaaatccatgactcaagaatggtatctttgtaaactccatcttttc

SEQ ID NO: 8201 - DNA, 589 bp, Homo sapiens
ccaaggcttccagggtctggtgcagggacgaagaggaacacagtgccccaaacactgggatgctctccactgctgctcccttgggggaaccatccagaaccatacccggtggactgcagcttgagaagaggtgggggtaaggaggagccaccctgcagggagtcagcagcagatgggaagaactcatgactccaggctgctgctgttgtaaatactgagccaagatttcttccccagtggtacatgcatgaagggcagagggtggaggtgtccctggggtgagctggcttgtgtggcatgctctgtctatacccctcagcaccactgactgggcaaagcaacgtgttccagaaggctccccacatgcagacagtggggtccatggggtggctcctccaaactgcatcagggaatcaggaagggactggcctggagccaaggggaaagggatgattgctcctgctgtcaccacctttttcccacagaagctcagcatgtcagccagatgaaccatggaaactggagaggaacacaggcgataaggaacagtgactgtgtccagggctgtagccaggatggcactgcagtg

SEQ ID NO: 8202 - DNA, 581 bp, Homo sapiens
  misc_feature (1)...(581): n = g, a, c or t
gtacaagcttttttttttttttttttttttttttttttgggattatttactaaataattgatntncatccaacatcactgaatggaaataatttaaaaataancaaggcttaaattggggtctttcaaaaaactcaaaacattcttggngactgtatntttaacaaatggaatgacaaaactagttaagtcatattatctcaatcaactccaaaactcaatgttgccaacatgtttttntacttaaaagcaaacaaaaagcaaagcctcataatttagtaattaccatgtttcttggtttctgttctcaaatgccacanaaagatncctgatgaaaggaagcaaagcncctagtctcatcagtcttnttcaaaactttaaggntgctttcacaatctcactataaatatttanattcctatctgacanatttnttcacttatgtgagtaggaatgctctcgaaaccttantctttactcttgcttcatactaaagctgttngattaaaccacctntgtatttgctggcctgcaacactanataanaactcattcctatctnttccaanaaaccaanataat

SEQ ID NO: 8203 - DNA, 586 bp, Homo sapiens
  misc_feature (1)...(586): n = g, a, c or t
ctgtgagcaaaaggagaagtatcagcttctcaagggcctagggtttgttggaagggcaaggcaggggcaaaggaggatacagaacaagggggcaagtaccagtgcctgggatggacccatccattcaggcagggggtgtggggtgtcccctgtgcttagaaaccacctagcatcatagctgcaacagcactttattgggatctgagtctacagttcacatagggaggtgaagccgtgggagaagcaggggtaaaaaaaaaaaaaaaaaaaaaaaaaaaaaggggggagggctgttgtgttggtgcagggggggtccatgcgcactttatcccctgagcgtagcagtgcctgatgccacatccgcttgagtggcaggcgagtgaanatgttgcccaaatcctggaccacaacagtgtccttctcatacctaaaatggctgggcacccctccagcacacggggcatanagattgtagatgttgaggccagagttgcccacgatgcgggccacttcctgaagattggtcacgcattccaggtctttgttgtcatanaagttacacttgttttganagcancagtgggtc

SEQ ID NO: 8204 - DNA, 610 bp, Homo sapiens
  misc_feature (1)...(610): n = g, a, c or t
ccagggccatccaaaacattgagatgacccaagaggatgtccgactcattggtctcagtgccaccctacccaactatgaagatgtagccacctttctacgtgttgaccctgccaagggtctcttttactttgacaacagcttccgtccagtgcctctggaacagacatatgtgggtatcacagagaaaaaagctatcaagcgtttccagatcatgaatgaaatcgtctatgaaaaaatcatggaacatgctggaaaaaatcaggtgctggtgtttgtccactcccggaaggagactggaaagacagccagggccatccgggacatgtgcctagaaaaggacactctgggtctgtttctgagggagggctcagcctccacagaagtcctgcgaacagaagctgagcagtgcaagaacctagagctgaaggatcttctgccttatggctttgctattcatcacgcaggcatgaccagggttgaccgaacactcgtggaggatctttttgctgataaacatattcaggttttagtttccacagcaactctagcttggggtgtgaatctccctgcacatacagtcatcatcaaaggcacccaggtgtncagtcc

SEQ ID NO: 8205 - DNA, 516 bp, Homo sapiens
  misc_feature (1)...(516): n = g, a, c or t
ccaagaattcaaggacttgtaggagataagtgaaggctattacagggattttgtcctggtttggtaggtttctcttggagaaataccactacaccctggtctagaaatgagttttgaagacttggggagttaaagggcactgagttttgctctcaccgtaccctgattccaggttttacatggagaaataacctgagggactttatttctatccaatgccctggtttccatcctgaccagaggatgatgacatccgctgataggccatgcttctgtcttctcttatgtgcctcatgccaagcctcgaaatataccttctggaccatcatttccacatctaccttgtgactagaagtcctagttatggtattttgaaatttatgatccataatccttgccagaaatcctgcagcgaaccatggcatggcatcatcctagtcattgatttcaatcttttgccttttgctcccctggaatcttgggccaattgcaggagggggctctgtttgnctctct

SEQ ID NO: 8206 - DNA, 414 bp, Homo sapiens
  misc_feature (1)...(414): n = g, a, c or t
ctgttttaagtgtattaacgcattttggtaaatttacagacttgttcaaccacaaccacagtctgattttagaacatttccatcaacttcaaagatccctggtgccatttgtagtcctccaacccatctccgatctatcttgtttctatgacttgccttttctggctatttnatataaangggatcatatgacatgtggntncctatatctgacttttttcatttagcataacgtttntgangctcatccatgttgtannactccatgccatgttgtgggctacataatattccatngnatggatataccacattttgcttatcanttaatggacatttangttttgnctactttttggcattaatagtgctgntnngaacaancatgtataantctttgtatnanagccactt

SEQ ID NO: 8207 - DNA, 606 bp, Homo sapiens
  misc_feature (1)...(606): n = g, a, c or t
ctgaacagagaaaggaattaaaacgctttaattaaaaaatcacgagtggatgataaagtgtgtagaaactgaaaatttacaaactatttaaaacctggaatcgctgactgttcagaaactacacagatggatcatgggtggtggtgaacagcagaaagggattatggatgaatctgcattgttctagctgctccccatgccacccgtctccgaggaaagcctgacattgattagatattgagccaggctaatgctggcagcagatccagtgatggtaacctgcctatcagtagatccttccactgggttcgcaattttgatctgcgccccagacatctgacggatctcattgattttggcgccttgacgcccgattatgcagccaatcaaatcgtttggaatggtgagttcatgagaagtagtctgagcagatgcatccaaacctgcccaatagcctttcacctctggagagctggattcaatgccactgaatccggtgttgccatgcgtcatgggaaaatgagactgttgcattgccaactggtgcagcttggtcaaatctggctgnggaatggcatactgtccttgaatggtataggacctgcc

SEQ ID NO: 8208 - DNA, 392 bp, Homo sapiens
ctggcagatgcagaagaagcgatgtatcagaatgtggatggccgtgtttcggaatgtcctcacacctaccaaaacaggcgacctttcagcagagagatggatttggggctactctctccgcaggctcaggtcgaagattcgtagaggaacaatttagttttaaggacttcatccctccacctatccctaacaggctgtagattaccaaaacaagattaatttcatcactaaaagaaaatctattatcaactgctgcttcaccagacttttctctagaagctgtctgcgtttactcttgttttcaaagggacttttgtaaaatcaaatcatcctgttacaaggcaggaggagctgataatgaactttattggagcattgatctgcatccaagg

SEQ ID NO: 8209 - DNA, 390 bp, Homo sapiens
gcagaaaccagggtggttatgaccgctactcaggaggaaattacagagacaattatgacaactgaaatgagacatgcacataatatagatacacaaggaataatttctgatccaggatcgtccttccaaatggctgtatttataaaggtttttggagctgcactgaagcatcttattttatagtatatcaaccttttgtttttaaattgacctgccaaggtagctgaagaccttttagacagttccatctttttttttaaattttttctgcctatttaaagacaaattatgggacgtttgtagaacctgagtatttttctttttaccagttttttagtttgagctcttaggtttattggagctagcaataattggttctggcaagtttgg

SEQ ID NO: 8210 - DNA, 123 bp, Homo sapiens
  misc_feature (1)...(123): n = g, a, c or t
cccgcctcagcctcccaaagtgctgggagtncaggtntgagccactgcgcccagccagggatttcttttttaagngaaaaataaaaagatcactatntagacacatgtggctggaatgtggga

SEQ ID NO: 8211 - DNA, 293 bp, Homo sapiens
tcgactcacagatggatgacatggacatggacttagacaaggaatttctccgggacttgaaggagctcaaggtgctagtggctgacaaggaccttctggacctgcacaagagcctggtgtgcactgctctccggggaaagctgggcgtcttctctgagatggaagccaacttcaagaacctgtcccgggggctggtgaacgtggccgccaagctgacccacaataaagatgtcagagacctgtttgtggacctcgtggagaagtttgtggaaccctgccgctccgaccactgg

SEQ ID NO: 8212 - DNA, 501 bp, Homo sapiens
ggacgtgctcttcagaagcattagtgaaagggacccttacctcgtgtcctatcttagacagcagaatttgtaaaatgagtcagttaggtagtctggaagagagaatccagcgttctcattggaaatggataaacagaaatgtgatcattgatttcagtgttcaagacagaagaagactgggtaacatctatcacacaggctttcaggacagacttgtaacctggcatgtacctattgactgtatcctcatgcattttcctcaagaatgtctgaagaaggtagtaatattccttttaaattttttccaaccattgcttgatatatcactattttatccattgacatgattcttgaagacccaggataaaggacatccggataggtgtgtttatgaaggatggggcctggaaaggcaacttttcctgattaatgtgaaaaataattcctatggacactccgtttgaagtatcaccttctcataactaaaagcagaaaagctaa

SEQ ID NO: 8213 - DNA, 50 bp, Homo sapiens
  misc_feature (1)...(50): n = g, a, c or t
ttttttttttttttngctngcctgattttnattattnaaaaaantggaaa

SEQ ID NO: 8214 - DNA, 304 bp, Homo sapiens
  misc_feature (1)...(304): n = g, a, c or t
tatgtatttatttaagcatnnaatatttgtgcaagaatttggaaaaatagaagatgaatcattgattgaatagttataaagatgttatagtaaatttattttattttagatattaaatgatgttttattagataaatttcaatcagggtttttagattaaacaaacaaacaattgggtacccagttaaattttcatttcagataaacaacaaataattttttagtataagtacattattgtttatctgaaattttaattgaactaacaatcctagtttgatactcccagtcttgtcattgccag

SEQ ID NO: 8215 - DNA, 535 bp, Homo sapiens
ccactagctgaatcttgacatggaaggttttagctaatgccaagtggagatgcagaaaatgctaagttgacttaggggctgtgcacaggaactaaaaggcaggaaagtactaaatattgctgagagcatccaccccaggaaggactttaccttccaggagctccaaactggcaccacccccagtgctcacatggctgactttatcctccgtgttccatttggcacagcaagtggcagtgtctccaccacctgttgaatgaaagccaggtaaaaagggaaaagagagaaaagaaaaaaaagggattggcaccaaaactgtaaggcagtgtgctccccaacccaaaaggtagctgataaacccccaactctatcttaccaagaggctcctctgtaaattacctacctgtttacctcttaacatttacccagaataaagagacatagaagaagttctccattccaccttcctctgatcagaattctgccagcttatatgggtattagctttgtataggaccgcttacctatgatggtg

SEQ ID NO: 8216 - DNA, 602 bp, Homo sapiens
  misc_feature (1)...(602): n = g, a, c or t
actggataataagccatggggattgtggaacctaaaggcccaacagccacagactgggccatgggaagatacagagaggctccaggaaatgcggctgacatggtggggactgtggcagcccctgggtgcacaaagctcggacgatagagctagaagaggcagaagagaaggcaaaatgttactttatgacattcctatttgagatctctttaatgagctaattcttaattctccttatgcaggttatactttttgtaagattatacaagttgcctttccactggccttcaatattctcctggatcactttctgctatagctaatgttgggctcacagaacgcaaattcatcttctgcaccttagcctgtgccaaataacacaaaatcatcaaataatgcactttcaactccgacaaaaattgccaaattatatagtgttttagattattcatgttagcatttgtgaagagtaaatatgtgaagtcagatttagctaaggactaaaggaccaccctaagagtattcccagctagttcaaatctggcaaactggangcacctctgagtaggcaggtggagcatcggtatagggtggagcctgag

SEQ ID NO: 8217 - DNA, 527 bp, Homo sapiens
  misc_feature (1)...(527): n = g, a, c or t
ctggtttttaattctaatagtataaaaattggaaatttgaaatagttctgtaaaagaaaaaaatgtaaaaatacatctgctttctctcatggtttaatacagcattggaaggctttcagatgttttcttaaaaaaaaacaaaacccaaaaaaactcaacatttaaaaccaaatctcagcttcatttccagaaatattgcagtttggtttaggtaatgtttcatttaatctactccagtttccacaaaatggcattttattaaaaaaacctttcagttatttggtccttttgcaatttgctgtgcacataatgcctactgtaccaaacttttattgcctttaaatttagttgtaattttattgataaaatttaaatctagtgtctttatttcttctgttacaatagtgttgcttgngtaagcaggttanagtgcacagngtccccaattgttcctggcactgcaaaaccaaattaaacaattccacaaagaattctgacatcaatgtgttttcctcagtcaggtctat

SEQ ID NO: 8218 - DNA, 495 bp, Homo sapiens
cctaagttaagaatgctacagaaaaatatcgatccctaagcgtatttactgttatgtgaatgtgtgtgtcaaaggacttaggtgctttgggggagaggagggtgaagacaggaatttattcattgagcgaatagttattaagcgcccactctattccagacaccgttctaggcattaggtgaacagcagtgaacaaaacagacggaaatctgtgtctacttgtagctcacattttagagaggaaggcacatactaagcaaagtaattagaaacatactgtattttaggtcgtgatagtcctgaagagaaacgtaaagcagggaagaagggtataaagtgacacaggaaggtcttgctgaaaagatgacttttaagtaaagggctgacagaagtgggagatttaaccacgcgaatatcttgggaaagtgcagtcagacagagggaccagccattgcagaggtcatgaagcagaaacgtgctagaatagcaaggagg

SEQ ID NO: 8219 - DNA, 607 bp, Homo sapiens
ggcaggtgtggtgccttggctaagtccacagacttctgagaggcccacgctttcttcttctccagaaataaaccctgaaactcaagcagctttaatcagagggcaggattccacgatagcagcatcagaacagcaagtggcagcgagaattcttgattccaatgatcaggcaacagtaaaccctgtggaatttaatactgaggttgcaacaccaccattttcccttctggagacttctaatgaaacagatttcctgattggcattaatgaagagtcagtggaaggcacggcaatctatttaccaggacctgatcgctgcaaaatgaacccgtgccttaacggaggcacctgttatcctactgaaacttcctacgtatgcacctgtgtgccaggatacagcggagaccagtgtgaacttgattttgatgaatgtcactctaatccctgtcgtaatggagccacttgtgttgatggttttaacacattcaggtgcctctgccttccaagttatgttggtgcactttgtgagcaagataccgagacatgtgactatggctggcacaaattccaagggcagtgctacaaatactttgcccatcgacgcaca

SEQ ID NO: 8220 - DNA, 572 bp, Homo sapiens
  misc_feature (1)...(572): n = g, a, c or t
cctgaagatacattctattttgatcctgagtttactgcaaaaactcccaaagattcacctggcattccacctagtgctaatgcacatcagctttttcgggggtttagttttgttgctattacctcagatgatgaaagccaagctatgcanacagttggtgtacattcaattgttcagcannttacacaggaacagtattcagtttactgatggatatgaagtaaaagaagatattggagttggctcctactctgtttgcaagagatgtatacataaagctacaaacatggagtttgtagtgaanattattgataaaagcaagagagacccaacanaagaaattganattcttcttcgttatggacagcatccaaacattatcactctaaaggatgtatatgatgatggaaagtatgtgtatgtagtaacanaacttatgaaaggaggtgaattgctggataaaattcttagacaaaaatttttctctgaacganangccantgctgtcctgttcactataactaaaaccgntgaatatcttcacgcacaaggggtggttnatanagactnga

SEQ ID NO: 8221 - DNA, 536 bp, Homo sapiens
  misc_feature (1)...(536): n = g, a, c or t
ctggtttcagtgaaactgccaaaatcctcaagccaggaagtagaagccaaggagctgtcctttgttttggattacataaaccagtcacccaagtgcattgcctttggaaacgagggagtatatgttgctgcagtacgggaattttacttgtctgtttattttttcaaaaagaaaacaacatcaaggtttactttatcatcatcaagaaataagaagcatgctaaaaacaattttacgtgtgtatcatgtcacccaacggaagactgcatcgcatctggtcacatggatggcaaaattcgtctttggaggaatttttatgatgataagaaatatacgtacacatgtttacattggcaccatgatatggttatggatttggctttttcagtgacaggcaccagtctgctgagtggcggtcgtgaatctgtacttgtagagtggcgcgatgcaacagagaanaataaggagtttctcccgcgtttaggagctactattgaacatatctcagtctcgcctgcaggagatttattctgcac

SEQ ID NO: 8222 - DNA, 533 bp, Homo sapiens
  misc_feature (1)...(533): n = g, a, c or t
ccagtggaatgatgttccctgcaattaccatctcacctatacgtgcaagaaaggaacagttgcttgcggccagccccctgttgtagaaaatgccaagacctttggaaagatgaaacctcgttatgaaatcaactccctgattanataccactgcaaagatggtttcattcaacgtcaccttccaactatccggtgcttaggaaatggaagatgggctatacctaaaattacctgcatgaacccatctgcataccaaaggacttattctatgaaatactttaaaaattcctcatcagcaaaggacaattcaataaatacatccaaacatgatcatcgttggagccggaggtggcaggagtcgaggcgctgatccctaaaatggngaacatgtgttttcatcatttnagccaaagtcctaacttcctgtgcctttcctatcacctcgagaagtaattatcagttggtttggatttttggaccaccgttcagtcattttgggttgccgtgctcccaaaacattttaaatgaaagta

SEQ ID NO: 8223 - DNA, 477 bp, Homo sapiens
  misc_feature (1)...(477): n = g, a, c or t
ccaacatggagaaaccccatctntactaaaaatacaaaattagccgggcgtggtgtcgggcgcatgtaatcccanctactcaggaggctgaggcaggagaatcgcttgaacctgggagacagaggttgcagtgagccgagatcacgccattgcactccagcctgggtgacaagggcaagactctctcaaaaaaaaaaaaaaaaaaaattttttttttgactctcctgagtatctgggccatgccttgcttttcaccggtgttatctttatcaaaggcacctaaaccggcagggtcagtcacgtnacccagancacttaatagttccgtggaaaagcctcgccggttccagaggcagcccttggcagacctgcccgggcggccgctcgattatggcccaaacccatgcaatgggccagttctttgaaaggaatagtgttccataactcacacaaggagaaatagaaaatttgaatagg

SEQ ID NO: 8224 - DNA, 545 bp, Homo sapiens
  misc_feature (1)...(545): n = g, a, c or t
ccttctgtccacgcccaccttacctgctgcttcccagaagaggaagcgggaagaggaaaaagactccagctcaaagtccaagaaaaagaaaatgatctctactacctcaaaggaaactaagaaagacacaaagctttactgtatctgtaaaacgccttatgatgaatctaagttctatattggctgtgatctttgtactaactggtatcatggagaatgtgttggcatcacagaaaaggaggctaagaaaatggatgtgtacatctgtaatgattgtaaacgggcacaagagggcagcagtgaggaattgtactgtatctgcagaacaccttatgatgagtcacaattttatattggctgtgatcggtgtcagaattggtaccatgggcgctgcgttggcatcttgcaaagtgaggcanagctcattgatgagtatgtctgtccacagtgccagtcaacagaggatgccatgacagtgttcacgccactaacagagaaggattatgaggggttgaagagggtgctccgttccttacaggcccata

SEQ ID NO: 8225 - DNA, 569 bp, Homo sapiens
ccaaatcttagctatttgaggaatgtagggagaaaagccaccttctctctctatgtctgaaggttcccatggctgtctctttgcccaaggggcaaactttccatcagggcatcttctgtgcctctgaggatcattttccaattataggcaatggtagtacgtgtttcagtgcagaatgagatagagttgtttaatttgacaataaagcgatgcgtcaaaaacctcagtcaacacagtaagtgttttcttgttttcctgctgaccaacctaattctggtttcatacagggcagccaggtgcccacctaaaagactgcacttctcaacttccagttgtttctatggataatggttggaagcagaaattgggttggggcttccagataatcccccctcacagggactgcttcaagagaaagggatgccctttggttctttctcctttccactgcctggaatgtgatgtctgacactgtggcagccatactggcataatgaggccaactctctgccatgctaagagtggcagagctgggaattgaaaagagcctgctagccttgggttgcttc

SEQ ID NO: 8226 - DNA, 636 bp, Homo sapiens
  misc_feature (1)...(636): n = g, a, c or t
ccaaatgggagagtggttacaacacacgagctacaaactacaatgctggagacagaagcactgattatgggatatttcagatcaatagccgctactggtgtaatgatggcaaaaccccaggagcagttaatgcctgtcatttatcctgcagtgctttgctgcaagataacatcgctgatgctgtagcttgtgcaaagagggttgtccgtgatccacaaggcattagagcatgggtggcatggagaaatcgttgtcaaaacagagatgtccgtcagtatgttcaaggttgtggagtgtaactccagaattttccttcttcagctcattttgtctctctcacattaagggagtaggaattaagtgaaaggtcacactaccattatttccccttcaaacaaataatatttttacagaagcaggagcaaaatatggcctttcttctaagagatataatgttcactaatgtggttattttatattaagcctacaacatttttcagtttgcaaatagaactaatactggtgaaaatttacctaaaaccttggttatcaaatacatctccagtacattccgttctttttttttttttttttttttttganacagtctcgctntgtcatccaggctggagtgca

SEQ ID NO: 8227 - DNA, 389 bp, Homo sapiens
ctgtgatgagttgataccagagtatctcaattttatccgtggtgtggttgactctgaggatctgcccctgaacatctcccgagaaatgctccagcagagcaaaatcttgaaagtcattcgcaaaaacattgttaagaagtgccttgagctcttctctgagctggcagaagacaaggagaattacaagaaattctatgaggcattctctaaaaatctcaagcttggaatccacgaagactccactaaccgccgccgcctgtctgagctgctgcgctatcatacctcccagtctggagatgagatgacatctctgtcagagtatgtttctcgcatgaaggagacacagaagtccatctattacatcactggtgagagcaaagagcaggtgg

SEQ ID NO: 8228 - DNA, 355 bp, Homo sapiens
tcgacttttaaaagaggtatgagggctgggcgtggtggcttatgtttgtaatcccagctacttgggaggctgaggttgcagccaagattgcgccactgcactacagcctgggcgacagagcaagactctcaaaaggaggcatgaaatgcacctcaatcttttgctccaagtctgccaaagattgtcaaaccctccctgttaaaaaaaaaaatcagtttacctactctcccttctatataaaggaccctaaaattaaatgtcaatgccaaaatgcgaagtgcagatcgtcttctctccaaataagagttacttggaatccttaacaaatccaaggagaagaagcgaccactgcgaa

SEQ ID NO: 8229 - DNA, 337 bp, Homo sapiens; identical to SEQ ID NO: 7576

SEQ ID NO: 8230 - DNA, 286 bp, Homo sapiens
ggcatctctgtactgaaccccaacaaaaccaaggtccagggaagctgtgagggtgcccatccccacctgcttctctcattcccctatggacacctcagctttggattcatgcaggacctccagcagaaggttgtctacctgagctacatggcggtggagtgcaatgtgtccttcccccacgcagcacagtggacattctcggctcagaatgcatcccttcgagatctccaagcacccctggggcagagcttcagttgcagcaactcgagcatcattctttcaccag

SEQ ID NO: 8231 - DNA, 587 bp, Homo sapiens
ctggcattggtctagagctttataaggccattcagcgagggaccatcaagtgcaactttgcgggggttgccttgggtgattcctggatctcccctgttgattcggtgctctcctggggaccttacctgtacagcatgtctcttctcgaagacaaaggtctggcagaggtgtctaaggttgcagagcaagtactgaatgccgtaaataaggggctctacagagaggccacagagctgtgggggaaagcagaaatgatcattgaacagaacacagatggggtgaacttctataacatcttaactaaaagcactcccacgtctacaatggagtcgagtctagaattcacacagagccacctagtttgtctttgtcagcgccacgtgagacacctacaacgagatgccttaagccagctcatgaatggccccatcagaaagaagctcaaaattattcctgaggatcaatcctggggaggccaggctaccaacgtctttgtgaacatggaggaggacttcatgaagccagtcattagcattgtggacgagttgctggagacagggatcaacgtgacggtgtataatggacag

SEQ ID NO: 8232 - DNA, 364 bp, Homo sapiens
cctattctgaactgcagatgctgtcccccagcgagcggcagtgtgtggagacggtggtcaacatgggctactcgtacgagtgtgtcctcagagccatgaagaagaaaggagagaatattgagcagattctcgactatctctttgcacatggacagctttgtgagaagggcttcgaccctcttttagtggaagaggctctggaaatgcaccagtgttcagaagaaaagatgatggagtttcttcagttaatgagcaaatttaaggagatgggctttgagctgaaagacattaaggaagttttgctattacacaacaatgaccaggacaatgctttggaagacctcatggctcgggcaggagccag

SEQ ID NO: 8233 - DNA, 627 bp, Homo sapiens
ctgtggctgtctgtcagagaagcacatttttctgcagataattagaatggcttcccccatctctcacggactgtcccaagtctagaaaagaattgagttcctcttctattagtcaaataaaagggaagagaatgtttgtcttcctttcctttctgtagtgttaagaaaataaacgaacttaatgattctaaattatcagtgagcttaacactgtactatagaccaaagattaccttttcaaaaagtcctttgaggtgaaatattttgtatacgtaatacatagatgcacatataaacacacacatatagaatctcaatattttaacacttctttgggtagctgtactaactcactaaccctgaggaaaaagttaagaaattgaaagtgttttcttcaaaagttgagatttaacaataaaaggtgttactttgataactaaaaggaactttattatcctcttcctaaaataaaccaatgcctattctgaaaatggcacttgcaattacaatttgccattatcaaagctaccactgaggtagaggcattatctaaaacaaataccacttatcatttattggcagttacctcgagagagacccatacaccatcttctagcagagcacagt

SEQ ID NO: 8234 - DNA, 276 bp, Homo sapiens
ctgagataacgaggaaatattctgaaatggatcccaaatatttcatcttaattttgttttgtggacacctgaacaatacatttttttcaaagacagagacaattacaacagagaagcagtcacagcctaccttattcacatcatcaatgtcacaggtattggctaattctcaaaacacaacagggaatcctttgggtcaaccaacacaattcagcgacactttttctggacaatcaatatcacctgccaaagtcactgctggacaaccaacaccag

SEQ ID NO: 8235 - DNA, 312 bp, Homo sapiens
  misc_feature (1)...(312): n = g, a, c or t
cagctagtacccggngggtcaccatgangttcaatcccttcgttacctcggaccgcagtaaaaaccgcaaacgtcacttcaatgccccctcacacgtgcgcaggaagatcatgtcatncccgctttccaaggagctgcggcagaagtacaatgtccgctccatgcccatccgcaaggacnacgaggtccaggtagttcnaggacactacanaggncagcaaattggcaaggnanntccaggtgnacagaaagaaatatgtcatntacatcnancgggtgcngcgngagaaggccaacggcacaactgtccac

SEQ ID NO: 8236 - DNA, 601 bp, Homo sapiens
  misc_feature (1)...(601): n = g, a, c or t
aaaaaaaaaaaaaggggggggcacattttaagttgtcaacaaaattttttttcatcataaagttatacaactatagaggatgtaatttttgacctattttaaatattgtcattctaaaataagcatgtaatatcactttcaggatatattcagtggaatctaaatatcatagtggtttgacctcttacatcattcttttaaaagtagtcttttattaagagtcaaaaattttatatttttgttttcgttggactaattctaaaatttaagttcctcttacggaatgttatcaaaaattatatagttatatgcttagaagtcttctattgattaagccatcaaacttaagtacatcaaaatttgtactttaaagtttaaattcttttttccttgtgaacataatcctataaactaaaattttcctggaccaagttatttttgtagtttactaatatacaattgatcaaaacaatataaagctatcgtaacatgtgaaagattatacaaattgtaaaaattttgttggaaatatgtcttaatgagatgattagggctgtttttcccaattcacatttnccgtagggaaatattccttaaaact

SEQ ID NO: 8237 - DNA, 632 bp, Homo sapiens
ctaatatcataaataaggttgtttaagacgtgcttcaaatatccatattaaccactatttttcaaggaagtatggaaaagtacactctgtcactttgtcactcgatgtcattccaaagttattgcctactaagtaatgactgtcatgaaagcagcattgaaataatttgtttaaagggggcactcttttaaacgggaagaaaatttccgcttcctggtcttatcatggacaatttgggctagaggcaggaaggaagtgggatgacctcaggaggtcaccttttcttgattccagaaacatatgggctgataaacccggggtgacctcatgaaatgagttgcagcagaagtttatttttttcagaacaagtgatgtttgatggacctctgaatctctttagggagacacagatggctgggatccctcccctgtacccttctcactgccaggagaactacgtgtgaaggtattcaaggcagggagtatacattgctgtttcctgttgggcaatgctccttgaccacattttgggaagagtggatgttatcattgagaaaacaatgtgtctggaattaatggggttcttataaagaaggttcccagaaaagaatgttcatccagcctcctcagaa

SEQ ID NO: 8238 - DNA, 336 bp, Homo sapiens
  misc_feature (1)...(336): n = g, a, c or t
cttttttttttttttttttttttttttttanatatttnaaatacaactttattntgattctaaacgaaaaggaatgggaatgacagtaacaaacaanatttcaccactgaatattgngatgtgactgcagcagtcttatntntgaaactcaaggaatcaactgngttctaaaacagctaaatatgcaggtccaaacaatgaagttattttttaaactgccacattcactccgaagcccactcatntccttcagcatcccacanatgaagcacatgttccgcttagctagataataatgagggggcacacacnctgcaccgntgacatcacaggaca

SEQ ID NO: 8239 - DNA, 488 bp, Homo sapiens
  misc_feature (1)...(488): n = g, a, c or t
ctctttgggacatttaaccatactgtttgacaggaatgtaaggtaattattgacaaaagcacttttagatttccttgattaaagaggaaccatcagttttagatcagtaataatagttgtttatccattagaaaattgcatagctactgttaaggttttagttacattgcattcatgcattcaagttttaaatcttaaatttctttttattttcttcattttaaaagtacagaagtcagattctatttgtgcattttattgtcagaagctttgttgtgtatctttattatcttaactatttatttcagcatatatatagagacaagtctagaagctccctgaaaaactgacttgcgaaaaggaatcacagtggggaaagacttttanttaacaaaaccttaaacaaaaatggaatataaaatgattttttcccagccattgagaccaaatatatatggaatcttgactcttaattgnttgtctttaat

SEQ ID NO: 8240 - DNA, 162 bp, Homo sapiens
ctgcttcttcttgaagtaagcatcagtaagatgttttgggatttttacattgctgatatcgattttggttgaagtggcaatgacaaatttctggtgtgttcttcgtagaggaactcgattgaggaccagaggtccagtcacaagtaataagccactagccag

SEQ ID NO: 8241 - DNA, 553 bp, Homo sapiens
cctgtgagtgaagtgcctctcagagcagtcacccagggaagggaggagggcagggaacggggctaggggagatgcagggacagaaatcagcagaaacactccatgctggttctgactcgctccatctcgtgcaggaagctgtagaactgaggcaaggttaattctatatacacattttcggtttgatttcctttcttaaccaccaactttagttgtaaaaatatacttcccactttctccaattcgctgctcccagatgtcactccaaatttccactccatatctatgagctggttaatcatcagagtctgacctatggcccatcgagcaagggtgggagcattctgcttccacttttcagaaaagtaagtggctttctcctcactaagacccagagttatgaaatccgcctggacctgcttggctgtgagactcttcttcaaagcaccatttggaaccagaaggaggcttttcacgatgcttctgagggagccaagactgatctgattggtggtggcaaattcagagagctgagccagaaatctttccacct

SEQ ID NO: 8242 - DNA, 543 bp, Homo sapiens
  misc_feature (1)...(543): n = g, a, c or t
cctactgtaaagagatgatgcatggtaaaaggaaaatggcagctctatgttattaccagtagtgaaggtgaatgatggattgttacatacagagtaagacttaaatgttgtgaagtttcctacagtttgacaaccaaaacatctaaaaaattcaaataaattttaaggtaatcttgatcttggttgtgagttgcaccagagaggacagtttatttttagttaacttgtacttaacctgcacaataagagtggtgactgactcaaatgtaggtagtactttattgtattccaatttaaaaaaacaaaattaagtctatattttaaaaactctgacaatagcaagatatttaatgaactctacttcatatctagttcatttttttttctggtttgaaaaaaagatcancnttccctgaataaacaaaanngaatgtnaataancangaaaatacaaaaccataatttccaaaaacgaaatgaatgggccaacagtaaaatgcacaatgagccacaactgccctggtatttaagaaaataaaggtc

SEQ ID NO: 8243 - DNA, 462 bp, Homo sapiens
acgaggcaaaaaaaaaaaaaaaaacagtaaaaggtgtctaaataggaaaggaagatgtgaaattatcactgttacctgacaatgtgacgttacatacaaaaagccacaaagactccagaaaaaaactattagacctggtaaatgaatacagtaaagttgcaggatacaaaatcaacctacaaaaaatcagtagtgtttctaagtactaacaacaaactatctgaaaaagaaatcaagaaaacaataccatttataatagctaccaagtaaaataaaatacgtaggaatacatttaaccaacaaggtgaaagagccatacattgaaaactgtaaaacattgatgaaagaagttgaagtctgcaataaaggaaagatactctgtattcatagattagaagaagaattgttaaaatgcccatactactaaaagtgatttgcagattcaatgcattccctataaaa

SEQ ID NO: 8244 - DNA, 447 bp, Homo sapiens
ccactgtcacggtctgtctgacacttactgccaaacgcatggcaaggaaaaactgcttagtgaagaacttagaagctgtggagaccttggggtccacgtccaccatctgctctgataaaactggaactctgactcagaaccggatgacagtggcccacatgtggtttgacaatcaaatccatgaagctgatacgacagagaatcagagtggtgtctcttttgacaagacttcagctacctggcttgctctgtccagaattgcaggtctttgtaacagggcagtgtttcaggctaaccaggaaaacctacctattcttaagcgggcagttgcaggagatgcctctgagtcagcactcttaaagtgcatagagctgtgctgtggttccgtgaaggagatgagagaaagatacgccaaaatcgtcgagatacccttcaactccaccaaca

SEQ ID NO: 8245 - DNA, 494 bp, Homo sapiens
  misc_feature (1)...(494): n = g, a, c or t
cctctaaaatcagatcccctagttactcctctgttctgaatctggggaagtagtaaaccaaaaagacagggaaaaccagatatttagagtcgaagcagcatgcaaaaaataataatgtttttaactaatgaaggctactggagttactaagaatcacctaaaaatgtgctactgtaccttgctcattttgcagatttagaagctgaaacatgggttaggttacttactaaaagtccacctgtggcaacctgcaaataatgcttatttatactaaagatgagtttatctgatagagttaggaaatttcttcttttgagtaagagtattgctataacatatatttttttctgaaatgttttaaaatagaagtacacctaattgttattggttaaaaaaaaaaagccatatgtgaatgaggttggtttttgggttttttnttttctgaattgtattagtccaaaagaactaaattagggtacttgtgctgnaccaaa

SEQ ID NO: 8246 - DNA, 490 bp, Homo sapiens
  misc_feature (1)...(490): n = g, a, c or t
cctagtagtggggtgaggcttggattagcgtttagaagggctatttgttgtgggtctcatgagttggagtgtaggataaatcatgctaaggcgaggatgaaaccgatatcgccgatacggttgtataggattgcttgaatggctgctgtgttggcatctgctcgggcgtatcatcaactgatgagcaagaaggatataattcctacgccctctcagccgatgaacagttggaataggttgttagcggtaactaagattagtatggtaattaggaagatgagtagatatttgaagaactgattaatgtttgggtctgagtttatatatcacagtgagaattctatgatggaccatgtaacgaacaatgctacagggatgaatattatggagaagtagtctagtttgaagcttagggagagctgggttgtttgggttgtggcttagtgtcanctcgagataataacttcttggtctangcacatgaatattg

SEQ ID NO: 8247 - DNA, 493 bp, Homo sapiens
  misc_feature (1)...(493): n = g, a, c or t
tgggagagctagactaagttggtcatgatgcanaagctactcaaatgcagtcggcttgtcctggctcttgccctcatcctggttctggaatcctcagttcaaggttatcctacgcagagagccaggtaccaatgggtgcgctgcaatccagacagtaattctgcaaactgccttgaagaaaaaggaccaatgttcgaactacttccaggtgaatccaacaagatcccccgtctgaggactgacctttttccaaagacgagaatccaggacttgaatcgtatcttcccactttctgaggactactctggatcaggcttcggctccggctccggctctggatcaggatctgggagtggcttcctaacggaaatggaacaggattaccaactagtagacgaaagtgatgctttccatgacaaccttaggtctcttgacaggaatctgccctcagacagccaggacttgggtcaacatggattagaagaggatttta

SEQ ID NO: 8248 - DNA, 510 bp, Homo sapiens
  misc_feature (1)...(510): n = g, a, c or t
ctggtggatacagcgcgcacacagaagacggnctaccagcggaatcgaatgagatttgcccagaggaacctccgcanagacaaagatcgtcggaacatgtngcagttcaacctgnagatcctgcctaagagtgccaaacagaaagagagagaacgcattcgactgcagaaaaagttccagaaacantttggggttaggcagaaatgggatcagaaatcacagaaaccccgagactcttnagttgaagttngtagtgattgggaagtgaaagaggaaatggattttcctcanttgatgaagatgcgctacttggaagtatcagagccacaggacattgagtgttgtggggccctagaatactacgacaaagcctttgactgcatcaccacgaggagtgagaagccactgcggagcatcaagcgcatnttccacactgtcaccaccacagacgaccctgtcatccgnaagctggcaaaaactcangggaatgtgtttgccactgatgccatc

SEQ ID NO: 8249 - DNA, 436 bp, Homo sapiens
  misc_feature (1)...(436): n = g, a, c or t
ctgccccagtcaatgaagattatgcatgagatcatgtacaaactggaagtgctctatgtcctctgcgtgctgctgatggggcgtcagcgaaaccaggttcacagaatgattgcagagttcaagctgatccctggacttaataatttgtttgacaaactgatttggaggaagcattcagcatctgcccttgtcctccatggtcacaaccagaactgtgactgtagcccggacatcaccttgaagatacagtttttgaggcttcttcagagcttcagtgaccaccacgagaacaagtacttgttactcaacaaccaggagctgaatgaactcagtgccatctntctcaaggccaacatccctgaggtggaagctgtcctcaacaccgacaggagtttggtgtgtgatgggaanaggggcttattaactcgtctgctgc

SEQ ID NO: 8250 - DNA, 503 bp, Homo sapiens
ctggccctgtcctgcagaatgaggtgtccggcccggtacagtgggtgttcatgcagatctgtctgggcgggaaacaccagcagctccggcatcaaggggtccaggagaaaatgcttccccttgagggctcgtaagtcatcgaggctgccagggaagaaccattcattcatcatttcctgaatttctccctgccaggccctatttcaacggtccattcatgcaacaaatgttaccacagctatggagaaatcaacagggtgataagggaatccgggatccgcagttgagggaatgggttgtcaagccagacttatgggtcaggagccccctctactgtttaccagcagtgggagcctgggcaagtgattcaatctcaagccccactggcatctctgtaaaatagtaggtgtgaggattcaatgagccaatatatccaagatacttacgtgccacaatttaataaatgttagctattcctgttgaagcataaccttggagaaagg

SEQ ID NO: 8251 - DNA, 236 bp, Homo sapiens
ccaagaagtacaagggccaaaagggcctggtcatcgccaagatggacgccactgccaacgacgtccccagcgaccgctataaggtggagggcttccccaccatctacttcgcccccagtggggacaaaaagaacccagttaaatttgagggtggagacagagatctggagcatttgagcaagtttatagaagaacatgccacaaaactgagcaggaccaaggaagagctttgaagg

SEQ ID NO: 8252 - DNA, 463 bp, Homo sapiens
  misc_feature (1)...(463): n = g, a, c or t
tcgacaaatacccacatgctgttttcctctgctaacgagttgcagagaaaaaaaacagcatgaatttggattttaatcacacatttcttctggaatctcatgtggattaaagatgccagggacagacatttgacgtttatgtttctcttcatcagcctgccgtagggctatttctctctcttccaaaaacaaatcagaagtgtcttcacctgcaaattcctttatttgaactaggaaatctcttaaatgttccttgaaagcaggaatatcttgatttaagctgaaaagccctgtcacaaagagctttacttgagcatcttgtaggtgagggaaggccnacttaaggagattagccncatattcctgaanaaaganttggntgttaactggatttccaggatttaatgatgtacttatttttccttcttcaaccnaattaaacatatatgcaangaattgatgc

SEQ ID NO: 8253 - DNA, 466 bp, Homo sapiens
ccacaggggaaggcaagaggcgatagctgggggtcacttgtcactagatggaagctccttggtccacacagtcccaaagaaaggtctgcccttgggcccacgaaacccatcccagccctcacaggctgaacctcaccctgggttttcccagagaggtgcccaagaagacccaagctgccccaagtcagaggagcagcaggaaacagcctcagaagtccgtcactcttcagtactcctcccttagaatgtccacttcctgtttggtgaccatggcaaccaaaagacaatggcagtgcagtgcgtgtgggatgggggagctccatcttccttgggtacatggggaggagactccagtgaccaggagaagcggggagagccatgggagatgttagagggacccagagaagatgggggacaggaaaaaggagagaatctgtctcaagtaaatggcctcctgccttggacc

SEQ ID NO: 8254 - DNA, 447 bp, Homo sapiens
ctgaaaggaggtggatggggacagagcaccaaggggaaggggccctcggcccaaggggggaggaacctagcccccaccccgctacagctccccactgaattcacagcacagagaacacctctcgcccaacaactccacatggaggtataccaagtccaggggtcaaaggagcaggtgggtgacagatgggcaggggcagtgaagatgacagcaggctcaggaggggaggtggcagaaacttcctcctacccatgggaggagacgatggggcgactgatattgctgttggtggtcatggcattcagctcccacctgatatcatgaggcaaacaggactggtctaggttatactgaatcacggccagtttgcacagagtcttcagactagggctaaagtccaaaatgtgtaagtcagaatgatctataaggtcaaattcatctcccagg

SEQ ID NO: 8255 - DNA, 539 bp, Homo sapiens
ctgacatcctaaaaacgaagtcaaattagggaaggatggccgtttccttgagtcaaaagcccagcaggattgcattataatgtatatttcttctgtagcataaaatggctgatccattttaaatccattttgaatcagtttgtagaagttagcatcaaccggaatgccagggtaaggattcacaccaagtgagaagatttcccacagtaatattccatatgaccagacatcactcttaatggtgtagatgccttcaaacaggctttcgggggccatccattttacaggcagacgggcattgcccctgacaacatagttggaatcactcatgatatctcgagccaatccaaagtcacatatcttcaccactttcccgtgggtgacaagcacgttcctggcggccaggtctctgtgaacacacgacttaaattccagaaattccattcctttggcaacttgatatgcaaagcaaagaagatcttcaaatgtaagcacattcaagtcctcctcttcttccagccttttttggttttcatatt

SEQ ID NO: 8256 - DNA, 401 bp, Homo sapiens
ccatcggtgctgaaattgagcattttaaatagtacagtaggctggtatacattaggaaatggactgcactggaggcaaatagaaaactaaagaaattagataggctggaaatgcttactttctgctctcattttctttcattttgtctgctgtctttttgaatgccaatactttcatttaaaatgttttgggagcacggcaacccaaaatgactgaacggtggtccaaaaatccaaaccaactgataattacttctcgaggtgataggaaaggcacaggaagttaggactttggctgaaatgatgaaaacacatgttcgccattttagggatcagcgcctcgactcctgccacctccggctccaacgatgatcatgtttggatgtatttattgaattgtcc

SEQ ID NO: 8257 - DNA, 383 bp, Homo sapiens
ctggcagaccccccaaccacatcagaggagttttcatttcttcctgggctgcttatctgggaagccttcaaagaattcgttacacatcatggcgatgcaggacaggaagacacagtactcttggaagtccacctcgttgtccctgttgctgtccaagttgctcatcagcttctggaaagcagcttcatctgtccttttccccaagaagctgggcagctcccgggtcagcagctcctttagttctgacttgttgagcttgaacttgtcaccctctttgcccgagtacttgtggaaggtggacaccatcacatccagggccttctccagagggcacgccatgacagcagtcaggatcaaaccaagaaagaagaagcgctgaggag

SEQ ID NO: 8258 - DNA, 442 bp, Homo sapiens
  misc_feature (1)...(442): n = g, a, c or t
cctagtagtggggtgaggcttggattagcgtttagaagggctatttgttgtgggtctcatgagttggagtgtaggataaatcatgctaaggcgaggatgaaaccgatatcgccgatacggttgtataggattgcttgaatggctgctgtgttggcatctgctcgggcgtatcatcaactgatgagcaagaaggatataattcctacgccctctcagccgatgaacagttggaataggttgttagcggtaactaagattagtatggtaattaggaagatgggtagatatttgaagaactgattaatgtttgggtctgagtttatatatcacagtgagaattctatgatggaccatgtaacgaacaatgctacagggatgaatattatggagaagtagtctagtttgaagcttanggagagctgggttgtttgggttgtggctc

SEQ ID NO: 8259 - DNA, 357 bp, Homo sapiens
ctgttgaggtgcagggcctcagctttgtcccggtgtgccacctctgaaccctgctgtctggtttaagtaccactcctgtgggaatggtggcattgttcctagttgtgcccggttcccactcccctcccccaggactggttgatgtctagagctgcctttcacgtggccccaccctcccctcttgcatagtggatctgaaaagcagcaccttgtgacttaacatcacctgcttcatgtgctgggctagctctcgtgccagccaaactcgggaggaaaagggacctaggatctaggcaggggctgggctgaaatcagtagagggcagggaggaaagaacacagttcccacgctctcatc

SEQ ID NO: 8260 - DNA, 391 bp, Homo sapiens
ctgaaaaaatcctggcaaactacaagctgtccacaagaaagcaaagcaacatgtttgaaggggtatggagtgctaactctgtgccacttttgcaagcaattttgctcagtctgtcattgtattagccttaacaaaactccttgtaattatagacgtttttattcaaaataagatcttactattatacaggtttctctcttttgactatatacagaagtgcaaaaagtcaaccttctccctagacgttccaacatgctaaattgcagcataatcaaccctcaagagtttgcacacacgctataattttcattacgtaaactttgagtatttggattatcaacaaaaagtcccttgttctatttattgattatgcagcttatttataacaagg

SEQ ID NO: 8261 - DNA, 501 bp, Homo sapiens
  misc_feature (1)...(501): n = g, a, c or t
ggcaggtctgctgctaccaccctgactggaccagttctatcaagatacaacctagcaacaccctggaactcctagtcacaggcttactccccaaacccagcctattagcccagcctggtcccatggtggcccctggcgaaaatatgactcttcagtgtcaaggggaactgccagactcaacatttgtcctgttgaaggagggggctcaggagcctttagagcaacagaggccaagtgggtacagggctgacttctggatgccagcagtgagaggtgaagactctgggatctatagctgtgtttattatttggactctactccctttgcagcttcaaatcacagtgactccctggagatctgggtgactgataagccccctaaaccctctctgtcagcctggcccagcaccatgttcaagttagggaaggacatcacccttcagtgccgaggaccccnnccaggtgttgaatttgtcctagaacatgatggagaagaagcac

SEQ ID NO: 8262 - DNA, 347 bp, Homo sapiens
  misc_feature (1)...(347): n = g, a, c or t
ccaagagatgcagtgccaggaacccttaaacagttgcacagcatctcagctcatcttcactgcaccctggatttgcatacattcttcaagatcccatttgaattttttagtgactaaaccattgtgcattctagagtgcatatatttatattttgcctgttaaaaagaaagtgagcagtgttagcttagttctcttttgatgtaggttattatgattagctttgtcactgtttcactactcagcatggaaacaagatgaaattccatttgtaggtagngagacaaaattgatgatccattaagtaaacaataaaagngtccattgaaaccgngattttttttttttt

SEQ ID NO: 8263 - DNA, 297 bp, Homo sapiens
ctgtgtctctctttcctcttctgttcctataagggcagggcctccttcaggaacagccaccagtgagcttcctcctcccttctggtcagttggatttgtcactgttcagcatcttttcgatgattttcttaactatgggggatgcaggattgaggcaagctttccgcccattcttgagtgtggctatgacttcggtttgggcgcagtggggtccgggggacttcacgttcacactttggatgttcttggggtgaattccctgcagggtctgcaagcactggcagcgcagttcagtgg

SEQ ID NO: 8264 - DNA, 505 bp, Homo sapiens
ccatggttgaatatctggatgctatagaacatgcttataatggacttgctgcccagagatgtttaggaagttcaagtggattctgagccagatggttgctttagatccgcaccagtacgcaaaagttctatagccaacatactgcgttaacttgacacggtttagaccagttagactgtgcaaaaataggtagtctgcacacactacatgagccctttagcaccctgtttgctttagcactttcatcactttgttttccaaaaactcaaaacagccaaaaaactgatttgatatgggaatcacggtatttttcttgtgttttgttttgtttgtttgtttccaaattgtctaaatcactaaccaagatcattcgaccagcttaggaaaaacaaatagattgtgcatttgagttcagttttgattctgtaaagactttgcaaagcctacttcactaattatgtgctactgttaaatggtatttgataggttgttggaaaagataggg

SEQ ID NO: 8265 - DNA, 491 bp, Homo sapiens
  misc_feature (1)...(491): n = g, a, c or t
accagtctcagcctcccaaagtactgggattataggcgtgagccactgtgcacggctgctgacccacatttaatagtataatgacattccctctaacagtgtcatttttgttttctttgtaccaataggtaatttgtcgtccagatgctctgctatatgtgaagtatcatttttctattgaacacaggtcatccttcagtttcatttttctcttcaccaattggatgctgcatacctggttttcagctcattcatgtgttagatcccctgtgtcctagatcgtatacctttctctttcttgatttactttctcattttatagagcacatcattgagtagaaagatggaaaataatttttgggatttatacaattaaaaatcattagtctcccttcaactttagtaataaaattgtagattggaaattattttccctcagaattttaaaactctttttctgnttctcttancttcttttcaggttgagaaga

SEQ ID NO: 8266 - DNA, 488 bp, Homo sapiens
  misc_feature (1)...(488): n = g, a, c or t
ctgtggtttgttgtcaattggtggctgttggctggtctgcttagttatatcagtgaggaaggggacaatgttagaccttgtactgctgggacttagtgatgtcactgatgacaggaagcttctagttggttggttagtttcattggcctgatctggagagagtggactgagaattactggggctgtgagaacttgccttccctagaatcatggcctgtctttttcccacacaggaacttgagcttgttcctccctacacaggaacttgggggccaatagcattgtccctgattttcatnttttcactggttgtattattggagaattttactgtttaaaatgtaaatgaaaaatttatattctcattcagttcacatcagcaaagcattactcccatttaggggtagttttttttttttttttaaatgacatctgctaaaatgggatcctttatnnatcagttttagttacnatattattttctccaa

SEQ ID NO: 8267 - DNA, 253 bp, Homo sapiens
ccttatgaaggacattgtaggagccaatgagaaagaaatagccctaatgaatgctttgactgtaaatttacatcttctaatgttatcattttttaagcctacgccaaaacgatataaaattcttctagaagccaaagccttcccttctgatcattatgctattgagtcacaactacaacttcacggacttaacattgaagaaagtatgcggatgataaagccaagagagggggaagaaaccttaagaatagag

SEQ ID NO: 8268 - DNA, 510 bp, Homo sapiens
cactgtcaggaccaatttacttgatttttgaatactgttgctatggtgatcttctcaactatctaagaagtaaaagagaaaaatttcacaggacttggacagagattttcaaggaacacaatttcagtttttaccccactttccaatcacatccaaattccagcatgcctggttcaagagaagttcagatacacccggactcggatcaaatctcagggcttcatgggaattcatttcactctgaagatgaaattgaatatgaaaaccaaaaaaggctggaagaagaggaggacttgaatgtgcttacatttgaagatcttctttgctttgcatatcaagttgccaaaggaatggaatttctggaatttaagtcgtgtgttcacagagacctggccgccaggaacgtgcttgtcacccacgggaaagtggtgaagatatgtgactttggattggctcgagatatcatgagtgattccaactatgttgtcaggggcaatgcccgtctgcctg

SEQ ID NO: 8269 - DNA, 486 bp, Homo sapiens
cgcgagcgccctgcagactgagggagagagagagaaagaggaggggaggaggaggaggattcagggaataggagctggggagcccttctgcgccacaggttcaagcgattctcctgcgtcagcctcctgaggagctgggactacagtgatatcagtatcaagataaaagtttggaatgggagaaaaattctcaaagcctgaaagaaaatctgtagttacttttggtgacgctgtccagttcccacaatgtatcattccttatctgaaactagacatcctctgcagccagaagaacaagaagtaggcattgaccccttgtccagttactctaacaagtctggaggagattcaaataaaaatggaagaagaacaagttctactttagactctgaagggacttttaattcctataggaaagaatgggaagaactatttgtaaacaacaattacttggcaacaataaggcagaaggggattaatgggcag

SEQ ID NO: 8270 - DNA, 362 bp, Homo sapiens
gtgtctcgtgggtgaatttgtaagtgatgtcctgctagttccagaaaagtgccagtttttccacaaagagcggatggaggtgtgtgagaatcaccagcactggcacacggtagtcaaagaggcatgtctgactcagggaatgaccttatatagctacggcatgctgctcccatgtggggtagaccagttccatggcactgaatatgtgtgctgccctcagacaaagattattggatctgtgtcaaaagaagaggaagaggaagatgaagaggaagaggaagaggaagatgaagaggaagactatgatgtttataaaagtgaatttcctactgaagcagatctggaagacttcacagaagcag

SEQ ID NO: 8271 - DNA, 496 bp, Homo sapiens
  misc_feature (1)...(496): n = g, a, c or t
ctttcctgccagtgtcagaaaatcctatttatgaatcctgtcggtattccttggtatctgaaaaaaataccaaatagtaccatacatgagttatttctaagtttgaaaagtaaaaagaaattgcatcacactaattacaaaatacaagttctggaaaaaatatttttcttcattttaaaacttttttaactaataatggctttgaaagaagaggcttaatttgggggtggtaactaaaatcaaaagaaatgattgacttgagggtctctgtttggtaagaatacatcattagcttaaataagcagcagaaggttagttttaattatgtagcttctgttaatattaagtgttttttgtctgttttacctcaatttgaacagataagtttgcctgcatgctggacatgcctcanaaccatgaatagcccgtactagatcttgggaacatggatcttanagtcactttggaataagttcttatataaatacccccagcc

SEQ ID NO: 8272 - DNA, 508 bp, Homo sapiens
ctgccatctgggcatttgcaatgtccatgcatactcttgaagcagcattcaattctgttcccccttttcaatgtatggttcatggggtttggtatcttgataggactaaggaaggggaagctgtcataaaccaggaagggaaatatttaattggaaagaacaaggctgttcattcaaattgcatttcctacagatttatccaataatggacaagtcaagccgcacacgtcttgctctcattatctgcaatgaagaatttgacagtattcctagaagaactggagctgaggttgacatcacaggcatgacaatgctgctacaaaatctggggtacagcgtagatgtgaaaaaaaatctcactgcttcggacatgactacagagctggaggcatttgcacaccgcccagagcacaagacctctgacagcacgttcctggtgttcatgtctcatggtattcgggaaggcatttgtgggaagaaacactctgagcaagtcccagatatacta

SEQ ID NO: 8273 - DNA, 601 bp, Homo sapiens
  misc_feature (1)...(601): n = g, a, c or t
ctgggaagccacgagaatattgtgaacctgctgggggcgtgcacactgtcaggaccaatttacttgatttttgaatactgttgctatggtgatcttctcaactatctaagaagtaaaagagaaaaatttcacaggacttggacagagattttcaaggaacacaatttcagtttttaccccactttccaatcacatccaaattccagcatgcctggttcaagagaagttcagatacacccggactcggatcaaatctcagggcttcatgggaattcatttcactctgaagatgaaattgaatatgaaaaccaaaaaaggctggaagaagaggaggacttgaatgtgcttacatttgaagatcttctttgctttgcatatcaagttgccaaaggaatggaatttctggaatttaagtcgtgtgttcacagagacctggccgccaggaacgtgcttgtcacccacgggaaagtggtgaagatatgtgactttggattggctcgatatatcatgagtgattccaactatgttgtcaggggcaatgcccgtctgcctgtaaaatggatggcccccgaaagcctgtttgaangcatctacaccatta

SEQ ID NO: 8274 - DNA, 503 bp, Homo sapiens
cctggtagtgtgactacccggaataatcaggaaaggcatcaccaaggcagcagtagctgtgctgtgatcaaagaatgcacagggcttgtagctacaggagagagagaacagtggcaattccaggcagagggagtggcatgttcagcagcacaaggaggagagtggctgcccaggaaggaccctcaggagttctttccttgcagtaggggatggaggtggtgctaaggctggaagagagtgtgtggatccagattgcgaagcatttcaaatgccatgctagggagtttaaagatttttgccaaaatgaaatgatgtcaccagaaatagagcattacctgtctgcctggtgtgcattaggtggacagaagagggagacatagcaagtagaagactgttttaataaatagaccaggcaagaaattagatcttaactaaaagctcccaaatctttaggcatttcaggcatttctatgccagttggagactgggggaattccccgagg

SEQ ID NO: 8275 - DNA, 481 bp, Homo sapiens
gagcaattcctcgggaaaaaatatttagcatagcagtaaagactgataggatgcctcaaaattcttaagttcacacgtatttcttaacgaatatactttccattacaaggttctatattatagtttttaatgacaaacttattaaacatctgggaaaggtccacttccttaaacctcttctccaaatcaggaacaggttagattgacatatttaacaggtagatttaggcatggtgtaggaatcatatcacctgggatttgtggtataggcacatcttattgaaatgaatgttttatgactttacctgatgaaccattaaggactggacctgccgtttgaggacctgcattctagctgttgtgacaactgaccgaacgtctggcaccacactctcactaagaatttcactgatgaggcggtggtttctctggaaacgggcggtggctgtatgcttcattgaaaagccatcatcataatctg

SEQ ID NO: 8276 - DNA, 516 bp, Homo sapiens
  misc_feature (1)...(516): n = g, a, c or t
ccccccccttttttttttttttttttttttttttnaaaaaaaggattttaggtttctttggngaaacaaaagcagatntaaaaagttacaaagattttanattttcattcacaaaaaaagtcattcacattttacactatacacgttatgatataaatncaggaaagtnttatgtgcattgtaaaganaaaggaaaaatagaaacctactanatcaacacagngttgttctgngctctaaaatacctaangggggattacatttaatgcaacanccaagggaacctgcttaaacatactgngtattattgnanctagagtcattccttntaagccaaaggnggttttataaaaaanaatcaatnttgggccaatccctttgngccctttttctctttttctatgggcatttnatttttngnctactcttcttcaagttgctctaaactgaaattagggaaggannctcactttccattacaggtttttntttaaacattaaattaagnggataagg

SEQ ID NO: 8277 - DNA, 489 bp, Homo sapiens
tgacagtgcaacatcttaaccaagaagtaaatatgacctcagtgtcctataaataatgtaagagcaggatttgaaacttggagagctgttttctcatttcatgtacacttgccccaaattgtctttgaagtcgtgtgcattgcacgttggatgagccagggaaattattacattaacaagcattttgtgtgtgcgtagtagttactttgtactgagagaacttgctttggggtgcaattaaacaataaactgattttatttgggagaaacaaggaagggtgcacttaactagcaacctaagcatgatttttcagcttttgcccttagggtttaaattacaattccaaaatgttagacatactgtattttttcgttcagtgtggctttaattttcccctcttgcagtttgttctgtaatgccttttacatttggacacatagtttatgctttttagattttggttgctttcttgccaaaataagtgttaa

SEQ ID NO: 8278 - DNA, 449 bp, Homo sapiens
  misc_feature (1)...(449): n = g, a, c or t
cctggctcaacaaaagggctggggattggccctgaaaggagagagctgactgtcctggctgatggacaggagatcctcttagcactaccctaaggcaggcagttgggcattggtgtagacaacaggaaagtccaggctatagccgtactcaaaaacctttctgttccctttctgccagccctagggattgagtccacattcagcacaggactctctgggtacagctctctttaggaagacacaaattgcatggtgaagtcagttatatcctggccgcctttggtccctcccaggaagacgggcatgttttctgcttgagaggtgctgatgtaccagttggggaactgggcagactcaaattccagcttgntattgatttctatcttgntgaagacaaatcgcttttccatcttcttctttgggtaatttttgggatctacactctccag

SEQ ID NO: 8279 - DNA, 493 bp, Homo sapiens
cttatttctcttgtcctttcgtacagggaggaatttgaagtagatagaaaccgatctggattactccggtctgaactcagatcacgtaggactttaatcgttgaacaaacgaacctttaatagcggctgcaccatcgggatgtcctgatccaacatcgaggtcgtaaaccctattgttgatatggactctagaataggattgcgctgttatccctagggtaacttgttccgttggtcaagttattggatcaattgagtatagtagttcgctttgactggtgaagtcttagcatgtactgctcggaggttgggttctactccgaggtcgccccaaccgaaatttttaatgcaggtttggtagtttaggacctgtgggtttgttaggtactgtttgcattaataaattaaagctccatagggtcttctcgtcttgctgtgttatgcccgcctcttcacgggcaggtcaatttcactggttaaaagtaagagacag

SEQ ID NO: 8280 - DNA, 422 bp, Homo sapiens
ccgcctgctactgagtaaggggcattcctgttacagaccaaggagaactggagaaagaaagagaaaatcagttcgtggttgcattgtggatgcaaatctgagcgttctcaacttggttattgtaaaaaaaggagagaaggatattcctggactgactgatactacagtgcctcgccgcctgggccccaaaagagctagcagaatccgcaaacttttcaatctctctaaagaagatgatgtccgccagtatgttgtaagaaagcccttaaataaagaaggtaagaaacctaggaccaaagcacccaagattcagcgtcttgttactccacgtgtcctgcagcacaaacggcggcgtattgctctgaagaagcagcgtaccaagaaaaataaagaagaggctgcagaatatgctaaacttttgg

SEQ ID NO: 8281 - DNA, 521 bp, Homo sapiens
ccacactctacttctgcttctgccacctatggggtcgaggcaggtgtggtgccttggctaagtccacagacttctgagaggcccacgctttcttcttctccagaaataaaccctgaaactcaagcagctttaatcagagggcaggattccacgatagcagcatcagaacagcaagtggcagcgagaattcttgattccaatgatcaggcaacagtaaaccctgtggaatttaatactgaggttgcaacaccaccattttcccttctggagacttctaatgaaacagatttcctgattggcattaatgaagagtcagtggaaggcacggcaatctatttaccaggacctgatcgctgcaaaatgaacccgtgccttaacggaggcacctgttatcctactgaaacttcctacgtatgcacctgtgtgccaggatacagcggagaccagtgtgaacttgattttgatgaatgtcactctaatccctgtcgtaatggagccacttgtgttgatggttttaacac

SEQ ID NO: 8282 - DNA, 285 bp, Homo sapiens
  misc_feature (1)...(285): n = g, a, c or t
cggaggaaaaggttggggaacagctaaataggttgttgttgatttggttaaaaaatagtagagggatgatgctaataattaggctgtgggtggttgtgttgattcaaattatgtgttttttggaaagtcatgtcagtggtagtaatataattgttgggacgattagttttagcattggagtaggtttaggttatgtacgtagtctaggccatatgtgttggagattgagactagtagggntaggcccaccgctgcttcgcangcggcaaagactagtatggcaat

SEQ ID NO: 8283 - DNA, 310 bp, Homo sapiens
ccaacattaaaaaaaaaaaaaagtaagacaattgccctggaatcccatccccctcacacctccttggcaaagcagcaggagtgctaactagctagtgcttcttctcttatactgcttaaatgcgcataattagcagtagttgatgtgcccctatgttagagtagaatcccgcttccttgctccatttgcattactgcaggagcttctaactagcctgaattcactctcttggactgttaatgtgcatacttatatttgctgctgtacttttttaccatgtaaggaccccacccactgtatttacatccca

SEQ ID NO: 8284 - DNA, 535 bp, Homo sapiens
  misc_feature (1)...(535): n = g, a, c or t
ctggctctggcatgaattttatttttaaataatttgttatttaaaatgaattactgaggggacagcccggctctctcttcatgattgttaccgcaactatatacaacagtttgctttccagattcaatttcgctttttctacattagatataaaagggggtaggttgaaagaggggagggtaaaataaaaaacataaacacacagacatacacatatcctggtttgggattttgcacccaataacttaaaaaaaaagtgttgcaaaaacttctgcccactctccacctgaggaacaccatgcatttgagaaacacggactctgtcacataaacggtgctgcctaaaacagtatggaggcggggaaggaagctagcaggggttggaattcattttgaaaaaagattgttttgttagaaaaagcaaaaacaaaaaagcattagaaagtgggagccactgcacagcagtagcctananactggctgcgatatggtagctntgccttgatatcatcttcgtgtcttcaggcatagagaa

SEQ ID NO: 8285 - DNA, 521 bp, Homo sapiens
  misc_feature (1)...(521): n = g, a, c or t
gagcccgttaggcagagtttgcagtgagccaaaattgagccactgctctccagcctgggtgacagagcaagactccgtctctaaatagatagatgaatgaatgaatgaatgaatgaatgaatgcagggcggccaggtgcagtggctcatgcctgtaatcccagcactttgggaggccgagggcagatcatgaggtcaggagttcgagaccaccctgaccaacatggtgaaaacccgtctctacaaaaaatacaaaaaaaaaaaaattagccaggcgtggtggcacacgcctgggtgagagtgagattccacctcaaaaaaaaaaaaaaaaaaaaaaaaangccgggcatggcagtcctgtggtccgatactcgagaggctgaggcaggaatttcacttgagcccacatggttgaggctgcagtgagctgtgccactgcactacagcaagaccctgtctccccaaccaaaaaaagaaaataaatgttcgtataatttaaaaagaggccnggagttcaagacc

SEQ ID NO: 8286 - DNA, 500 bp, Homo sapiens
  misc_feature (1)...(500): n = g, a, c or t
aaaattgaaaaaaaaaaaaaaaaangctaancaaaaaanccaacttgttttccattaataaaagggggaacctgagtcacatgaggactggattgtcttanctacgtacttggcaatgtcactacacaaagaagaggaagtttggagaaggtctcagtgacataagggaaagttttatgtagggcaagactaaaagcagattgattacctaaaaaaagtttcctccctctaaagatgtttccgtaatcccttcctggctactcctggaataaccctaaattttgtatcaacaatcattagctcaaaatagagctgggcagaaaatacttccctaagattcttttatactcataagcatgtttttgnttttcattttgntttgttttgcactgaggngtatttgggtaaaatttccgngtgtgtcatgtgggactagtacagacttgggagcccaaggcttgntaatatcacttgatgctttcttggaggaccagtctact

SEQ ID NO: 8287 - DNA, 471 bp, Homo sapiens
ctgaagggtacagccatttcatagggtcctctcagagagtatttggtttgctttcctaactttctaaaaatagtagattacacaggccacctccatctcatggctcaagaactcagaaaaggctggactatggatttaagcaatacacaggacacattttattaaagaagtcaggattattacaagttttctaaatttttttccgtttactctgtgagagaatgcaaatgatctagcggttaatggcatggaaacctcataacgctcccaaatttcagaacttcaagcatgagtcatacagttactttaacagttttaaaatatgtttttgatctattttagccacaagactgaatacaagaggactgctatctgaagggaaggattctaaatactgtacaaagaatcacatgtgtcagttataaatatatacacacacacgtaagaaacatgttttttaacataaatgct

SEQ ID NO: 8288 - DNA, 449 bp, Homo sapiens; identical to SEQ ID NO: 8278
  misc_feature (1)...(449): n = g, a, c or t

SEQ ID NO: 8289 - DNA, 464 bp, Homo sapiens
ctgccagtttggagcattgccctctaagagctttaaaactatttttttacatgccttatatacattccactaatgacattcttataataatattaaacacatgaccttggtactaacatactcactgtgaacccagcctattgcaaaaataaaatctttttataatattatctatgggatgtcagcacaatataacactctgggaagaagtggagttttttggttattaggttaattttctagtaaaacacattgcctgttttcagttaacactggtaatgccattttaatatatggctttttcaaatcagttcagtgaaaatagtacagatttaggtttacataactactctgacatactggaattgcatatagagatgttcagtggtcgtttttcattttaagtaatttttgttttggcatttttttgtgtgaagtaaattaatcaactagagaggtgcaaa

SEQ ID NO: 8290 - DNA, 384 bp, Homo sapiens
ccacaacgtcaatattcctggttaccctacattagagtatgcttccaaagctgtgtgcataacatggaattctttagagtagccattactgcattttcccaagggaaatttgcaagaattggatacatcagaatttaatcagaaactaaagccatgtcttttcccagaacatgccccagacgtggtttttaattttttgttgttgttattttggttttttaacgaatatggtttttaactgacctataagacagtccatttaaatatataaatttttaatagccttccaggggccatttcctaaatcccacctgagaggattaaatgagacaacgtagccaaaccccaggcattctccccttaagaaccttgtttggggaatgg

SEQ ID NO: 8291 - DNA, 295 bp, Homo sapiens
ctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtggaaaaggagggagctactctcaggctgcgtccagcgacagtgcccagggctctgatgtgtctctcacagcttgaaaagcctgagacag

SEQ ID NO: 8292 - DNA, 506 bp, Homo sapiens
cagaagtaagcctcatcatcagagcctttcctcaaaactggagtcccaaatgtcatcaggttttgttttttttcagccactaagaacccctctgcttttaactctagaatttgggcttggaccagatctaacatcttgaatactctgccctctagagccttcagccttaatggaaggttggatccaaggagggtgtaatggagcatcaagccactcggcggcagcatggagctataactaagcatcctttagggttctgcctctccaggcatttagccctcacattagatctagttactgtggtatggctaatacctgtcaacatttggaggcaatcctaccttgcttttgcttctagagcttagcatatctgattgttgtcaggccatattatcaatgtttacttttttggtactataaaagctttctgccacccctaaactccaggggggaaaatatgtgccaatcaatagcacccctactcacatacacacacacctagccag

SEQ ID NO: 8293 - DNA, 512 bp, Homo sapiens
  misc_feature (1)...(512): n = g, a, c or t
cctttgcatgttaaagctgtataatttgttgggttgtgagtggtctgacttaaatgtgtattataaaatttagacatcaaattttcctactaactaactttattagatgcatacttggaagcacagtcatatcacactgggaggcaatgcaatgtggttacctggtcctaggtttgaactgtcttatttcaaaagatttctgaattaatttttccctagaatttctccttcattccaaagtacaaacatactttgaagaatgaaacagattgttcccatgaatgtatgctcatactcgactagaaacgatctatgttaaatgactgtgtatatgaattatttcaagtactaccccaaataactttcttattgctctgaaagaagaaaagcaatgtaaatcactatgattattgcacaaacaaccagaattctccaacaattttaagtaatctgatcctcttcttggagaaaattgttacctaatagtttttccttatgaatgntattactac

SEQ ID NO: 8294 - DNA, 383 bp, Homo sapiens; identical to SEQ ID NO: 7947

SEQ ID NO: 8295 - DNA, 467 bp, Homo sapiens
  misc_feature (1)...(467): n = g, a, c or t
canaaanttanctggtntggnggtgcacncccgtagtcccagctacttgggaggctgagacaggagaatcgcttgaacccaggaggcggaggttgcagtgagtggagactgagccactgaactccagcctgggtgacaaagtgagactctgtctcaaaacaaaaaacaaaaaacaaaaaaagaattagccaggcgtggtggcatgcgtctgtagttccagctacttgggaggctgaggcaggagaatgtcatgaacccaggaggtggaggttgcagtgagccaagattgcgccactgcactccagcctgggtaacagaatgagactccgtctcaaaaaaaaaaaaaaaaagaggaatgagaacatgtgaccacacaaagttttgtttatgaatgttcataataattttgtttttaatagccaaaaactgaaaataacccaactgcgcaacaatggttgaatggataa

SEQ ID NO: 8296 - DNA, 506 bp, Homo sapiens
  misc_feature (1)...(506): n = g, a, c or t
cctgccttaccgagagccaaacagagcccagggagactccgctgtgggaaacctcattgttctgtacaaagtactagctaaaccagaaaggtgattccaggaggagttagccaaacaacaacaaaaacaaaaaatgtgctgttcaagttttcagctttaagatatctttggataatgttatttctattttttatttttttcattagaagttaccaaattaagatggtaagacctctgagaccaaaattttgtcccatctctaccccctcacaactgcttacagaatggatcatgtcccccttatgttgaggtgaccacttaattgctttcctgcctccttgaaagaaagaaagaaagaagactgtgtttttgccactgatttagccatgtgaaactcatctcattacccttttctgggtttgaagctgctgtctctagaagtgccatctcaattgtgctttgtatcantcagtgctggagaaatcttgaatagcttatgtacaaaa

SEQ ID NO: 8297 - DNA, 477 bp, Homo sapiens
  misc_feature (1)...(477): n = g, a, c or t
ctgctttccccagaccagggggtccaatggctgcaatgtacccaaatggaatgttgcccccttaaacaccattttccctccaggaccaccttggtttctaggcactgtggttcttggcaggggctgtcttaggtaaaagggtagttgtggagctacagtctgaagaacatagcttgggctcaagttcaaatgagccatctttttcctttgcgtttttcttgactgaaggtgagatgttatttgtggcatgtgaactgtggcaggtgggaataatcctgcccttgagagaaaggatctccagcctcccagaagcctgctgtgctttcgtcccacagctttctgcccattgtttcttactagtttcttgaattgttcttgtggacttttcctcagggatacattggcctgcaggtcccagttcacatgtagtcccctgctcaccattggagaatcagctcactgntctctanaaacgtg

SEQ ID NO: 8298 - DNA, 546 bp, Homo sapiens
  misc_feature (1)...(546): n = g, a, c or t
ctgtcaacctttctttaactgaggaaacatttgagggctctgctgatgttctggctagctacactcaggcaacacatgatgaatcaatgacttatgaagatagaagccaactagatcacatgggctttcacttcacaactgggatccctgctcctagcacagaaacagaattagacgttttacttcccacggcaacatccctgccaattcctcgtaagtctgccacagttattccagagattgaaggaataaaagctgaagcaaaagccctggatgacatgtttgaatcaagcactttgtctgatggtcaagctattgcagaccaaagtgaaataataccaacattgggccaatttgaaaggactcaggaggagtatgaagacaaaaaacatgctggtccttcttttcagccagaattctcttcaggagctgaggaggcattagtagaccatactccctatctaagtattgntactacccaccttatggatcanagtgtaacanaggtgcctgatgtgatggaaggatccaatcccccatattaca

SEQ ID NO: 8299 - DNA, 326 bp, Homo sapiens
ctgagaccaaaattttgtcccatctctaccccctcacaactgcttacagaatggatcatgtcccccttatgttgaggtgaccacttaattgctttcctgcctccttgaaagaaagaaagaaagaagactgtgtttttgccactgatttagccatgtgaaactcatctcattacccttttctgggtttgaagctgctgtctctagaagtgccatctcaattgtgctttgtatcagtcagtgctggagaaatcttgaatagcttatgtacaaaactttttaaattttatattattttgaaactttgctttgggtttgtggcaccctgg

SEQ ID NO: 8300 - DNA, 512 bp, Homo sapiens
ctgcctttcctgggagccactttgattccactgaacgcccttcctgccctttccacttttggttccaaagccctccctagtttccatcagaggttctacaacatgaaaataagtcccacctcacagatttgttccacgtaacatgcccctactgatggtcattggattactctcttccattgcaaaataaattcagaatcagacttttctggggttgaattttattcctgactgtgacatgagctaggaaaagtcagttcacctctctgagagtgttttcccatacttgaaattgggggggagagataaagtcaataatcattagcattattacggggataaaataagctaatttgtgtaaagtgtttaatgtgatgcctggaaaagcataagtgcttgacaaagagtagctattactggggcaattattatgacttttgttatcatcgttattgaaaacttattgcttgagcacaatctgggctaagtaggaaactaagtgaatgtgatgc

SEQ ID NO: 8301 - DNA, 580 bp, Homo sapiens
ctggtgagaggaggagttagagctggtcgttttgtgattacccataatattggaagcagcctgagggctagttaatccaaacatgcatcaacaatttggcctgagaatatgtaacagccaaaccttttcgtttagtctttattaaaatttataattggtaattggaccagttttttttttaatttccctctttttaaaacagttacggcttatttactgaataaatacaaagcaaacaaactcaagttatgtcatacctttggatacgaagaccatacataataaccaaacataacattatacacaaagaatactttcattatttgtggaatttagtgcatttcaaaaagtaatcatatatcaaactaggcaccacactaagttcctgattattttgtttataatttaataatatatcttatgagccctatatattcaaaatattatgttaacatgtaatccatgtttctttttcaaatctaaagttaaaaaaaaaatagcagaagccagtgtcttaaagtctatcttttgtttctaagaccatgggatttcataatctcaagataaaatatgtatgaag

SEQ ID NO: 8302 - DNA, 457 bp, Homo sapiens
  misc_feature (1)...(457): n = g, a, c or t
ctggtcctaacttttatacaaagtgaaactatatagagctcctttgccaacataaggagctacataatttctattacacttgcctaggcatgagaaacgcaaaagcaactcaaaaggagcaagtccaggaaaagaaaagctatgaaggagagaaagactagcagatgaaacacatactctgaaaaactccaatctgccattcaagtattggaaataccccaaaggggacaatgaatgggatctattacaacaaagtcagcaaagtaaaatgcaaatctcacacatgataaatggccctgataggctgtttgctgaaagacctaaggctagtgattcagtccacaattccttctggaccctaaagaaggggttcatataaaagtcatacttgtctttttgcaattttctcttggttgncttcagagaatagtcatttgcttctttcattcaggttatg

SEQ ID NO: 8303 - DNA, 456 bp, Homo sapiens
  misc_feature (1)...(456): n = g, a, c or t
cctatgtatggtggattacattttgcacatctcgacattgttttcattgtttccacaaaaattctgcctgtctcgtcagagtgctttgattaagcattactggttatggcaaacttgaactatataattgttatttgtattacaacatccatatggcttcttactatttttaaaattgttattaagagtgtacactangtatttgtgggttcatgtgagaaaataacaagcatttaaaaaactctttccatgaaaaaataaattctggattttccaacataactttaaaacanaattttgggatgcaaattattcataagctgcagtgtgacggtattcctgggaacataatggtatgttagagtctttactcaaaagcaagacacccagtgacaaggcacattcaagctcttctgttaagatcccgctcaagtgttttctcctttgtgaagtatt

SEQ ID NO: 8304 - DNA, 571 bp, Homo sapiens
  misc_feature (1)...(571): n = g, a, c or t
aganntgtnatacgacncactatagggcgaattgggccctctagatgcatgctcgagcgctgagagatcccctcataatttccccaaagcgtaaccatgtgtgaataaattttgagctagtagggttgcagccacgagtaagtcttcccttgttattgtgtagccagaatgccgcaaaacttccatgcctaagcgaactgttgagagtacgtttcgatttctgactgtgttagcctggaagtgcttgtcccaaccttgtttctgagcatgaacgcccgcaagccaacatgttagttgaagcatcagggcgattagcagcatgatatcaaaacgctctgagctgctcgttcggctatggcgtaggcctagtccgtaggcaggacttttcaagtctcggaaggtttcttcaatctgcattcgcttcgaatagatattaacaagttgtttgggtgttcgaatttcaacaggtaagttagttgctagaacccatggctcctttgccgacgctgagtagattttaggtgacgggtggtgacaatgagtccgtgtcgagcgctgnntttttcggcct

SEQ ID NO: 8305 - DNA, 376 bp, Homo sapiens
cctaggtgtcggctgggcattgcctacacgtgaagagatcactccgcgtccccactgcacctgtcacaaagtgccttctgatatgcctggcaaaccaaaatcggtgagcgccagcttgcttccctagaagacatttctaaatattcataacatgcttgctcaaatcaatcaccttattttacatccgctccagggagaaatgaagacatggtcctacgttgttctgtaattattttctatgtaaattttgttccttgtcacaattatatatgtcttaggggaaaggaccatttcacatgtgtcacctcatgtgattctcaccacagccctgtgattgctcctgttttataaataatgacatagttccagttgatgg

SEQ ID NO: 8306 - DNA, 316 bp, Homo sapiens
ctgagactgcccagtataggaagaagcagaagatatgtaaggggtgttagggtaagcgtttgaagtaggaggagcaacaggctgctgaggtcgatacattgctgacccccctgttccgaagggatacggctgggctggttgataaggctgtggctgtggataaggtggtacctgggtgtgcatatgacctggagatgtgggaagctgaccagcagcatttggattaacatttccatgcattatgaaacccggaggtggaggattttctccatggggataatattgttgagtttgaactcttggcatctggtggtgg

SEQ ID NO: 8307 - DNA, 508 bp, Homo sapiens
  misc_feature (1)...(508): n = g, a, c or t
ctgcacatggattggttaacataatatatactgctatataatcttttaagggctaatatttgtagataatttaaaagcatgtcaatttcctctaagatttgattatttaacctgcacaaaggccaatcttcagttatcaatgacaagaaaactctagggctgccaaaataacttcattttagaccccagagttagtgttaggctggtaatgtttctaatttgggaataatgagactagaaagctaggagggccccctccaaatttctcccttgtattaggctgaagtagaacataacgtggcttaaagcataaacttaaagcatatgctttgagttttaaaaatgttaacctgtaattaattattagagtattatccatagtctactatgatagtcagttaatattctctaaatcagattatattcatttgaaaatgnatttgnatatttgcaaatgtgttattacacaagatcttacctatgtcaatttaaagaggttaaagatgca

SEQ ID NO: 8308 - DNA, 378 bp, Homo sapiens
ctgggaggtaaatggtgactgtatttccaaagaagctcttttgattcagaactccaggagaccctgacatgaaaaccttaaagcaaatgactgtcacatgcttcaaggagtttatgtcaagacagttctacttatgtaaagtaagattataaaatgaaagagagtgtataaagaaaatcctaaggaatccactaaaaaacaactagaacgaagaggcaagttcagcaaggttgcaagatacaagacctatatataaaaatcaattgcatttctgtacacttgtaataaacaatcaaaaaaattaagaaaattacatttgcatttgcatcaaaaatagtaaaatatttacaagtaaatttaacaaaagaactgcaaaac

SEQ ID NO: 8309 - DNA, 297 bp, Homo sapiens
cctgggtatctgaggcttgcttggcttgtgtccatgcttaaacccacggaagggggagactctttcggatttgtagggtgaaatggcaattattctctccatgctggggaggaggggaggagggtctcagacagctttcgtgttcatggtggcttggctttgactctccaaagagcaataaatgccacttggagctgtatctggccccaaagtttagggattgaaaacatgcttctttgaggaggaaacccctttaggttcagaagaatatggggtgctttgctcccttggacacag

SEQ ID NO: 8310 - DNA, 437 bp, Homo sapiens
ccttgcttatccaagagtcaaaatggaaattaccacacctactacagttgcctgagaattataacaccatttttcagtactaccacagaaaaacctgtagtgtctgcaccaaggttcctaaagatcctgctgtttgccttgtgtgtggtacttttgtatgcctgaaaggactttgctgcaagcaacaaagttactgtgaatgtgtactgcactctcagaactgtggtgcaggaacaggtattttccttttgatcaatgcatcggtaattatcatcattcgaggtcaccgcttctgcctctggggttccgtgtatttggatgctcatggagaggaacaccgggatcttaggcgaggcaaacctctctacatttgtaaggaaagatacaaagttcttgagcaacagtggatttctcatacttttgatcacatcaataaa

SEQ ID NO: 8311 - DNA, 254 bp, Homo sapiens
ccagggagcctctactcattttgagaattcctttgagggttcatcatttgcagtgggtgacattgccctggcactgtactcagctctgttctcctactcaggctgggacaccctcaactatgtcactgaagagatcaagaatcctgagaggaacctgcccctctccattggcatctccatgcccattgtcaccatcatctatatcttgaccaatgtggcctattatactgtgctagacatgagagacatcttgg

SEQ ID NO: 8312 - DNA, 433 bp, Homo sapiens
ctgcttctgatttgcacccaaaatggcaccacccaaaaaaacacaacctatgtcgggttcggatttttaagaagttatttcagttaagcagacactaaagtacaattatacttggcttcttgtggcataaatgatcttgaattttaagatcatttggcttttacctatttagaacaaaacagtctatattttcctgtacttagaagttggaaatgaaataatttttaaagcccacaggagattaatttgtactaagtcattactatgtatcaggcattgtgcttggtgctttctagtcactgaaggagtattaaatatgtgaaatgcctgtcacagtgacttgcatgtggcaatcactcaaagatccccttctttaaccaatgtggtgaggttgtagtattattataaatttttaattatataacaactgagg

SEQ ID NO: 8313 - DNA, 449 bp, Homo sapiens; identical to SEQ ID NO: 8036

SEQ ID NO: 8314 - DNA, 515 bp, Homo sapiens
  misc_feature (1)...(515): n = g, a, c or t
ccaacatggtgaaaccccgtctctactaaaaatacaaaaaaattaggcaggcatggtggcacactcctataatcccagctactcggtaggctgaggcaggaggattgcttgagcccgggaggtggaggttgcagtgagccaagatcgtgccactgcactccagcctggctgacagagcgactctgactctaaataaataaatacatacatagatacatggtaacttagttccctctctttcttttgtattgacaccagatttactcaatactgttttagtttgtcagtccaataagatgagaaaataagtatgagatgcaacttggaattaaagtgatcaaatgtttgctctgacagataagcttcagcacctgttaacttggagaatcaagtgaaactccaccggcttcatgtggaagctcgtcaggcagcatcacaacatgtacataacccaagagccgttctgtacaaggttctccttaaaatataatgggaggccnggcgcggcggctcat

SEQ ID NO: 8315 - DNA, 442 bp, Homo sapiens
  misc_feature (1)...(442): n = g, a, c or t
attttgagtacattgaagagaacaagtatagcagagccaaatctcctcagccacctgttgaagaagaagatgaacacttcgatgacacagtggtttgtcttgatacttataattgtgatctacattttaaaatatcaagagatcgtctcagtgcttcttcccttacaatggagagttttgcttttctttgggctggaggaagagcatcctatggtgtgtcaaaaggcaaagtgtgttttgagatgaaggttacagagaagatcccagtaaggcatttatatacaaaagatattgacatacatgaagttcgtattggctggtcactaactacaagtggaatgttacttggtgaanaagaattttcttatgggtattctctaaaaggaataaaaacatgcaactgtgagactgaagattatggagaaaagtttgatgaaaatga

SEQ ID NO: 8316 - DNA, 140 bp, Homo sapiens
ctgtcactttgcgggggtagcggtcaattccagccaccagagcatggctgtaggggcgatctgaggtgccatcatcaatgttcttcacgatgacagctttgcgtccggagtagcgtccagccaggacaagcaccaccttc

SEQ ID NO: 8317 - DNA, 386 bp, Homo sapiens
catcggtgctgaaattgagcattttaaatagtacagtaggctggtatacattaggaaatggactgcactggaggcaaatagaaaactaaagaaattagataggctggaaatgcttactttctgctctcattttctttcattttgtctgctgtctttttgaatgccaatactttcatttaaaatgttttgggagcacggcaacccaaaatgactgaacggtggtccaaaaatccaaaccaactgataattacttctcgaggtgataggaaaggcacaggaagttaggactttggctgaaatgatgaaaacacatgttcgccattttagggatcagcgcctcgactcctgccacctccggctccaacgatgatcatgtttggatgtat

SEQ ID NO: 8318 - DNA, 451 bp, Homo sapiens
  misc_feature (1)...(451): n = g, a, c or t
gaggtctgcagggncaggtctgcatagcagaggtcgccctccaggggctgcagtacctgctctggggacatcccggctgctttctgctggtacttcatcatcctccaagccaagagtgaggcggccaccaaaagcagcagcaatatggtgaagatgaggggcaggaggacactgagcttcaggagcttgtgcctgttgtccaagtggtggccggtcagagttggggagctgctagtttcttcttgggtgactggtgctgggtcaatggtcacttgaactgtgaccccaaggtcatttccagttttctcaattccacaccagtaagtgtcagcatcagttttcatganatcctccatggtcacagtgaacgtgcggtttttctgattgtccttgatggacacccggtccctcttcacctcctgctctgacccactggttttaacaaggatct

SEQ ID NO: 8319 - DNA, 280 bp, Homo sapiens
  misc_feature (1)...(280): n = g, a, c or t
ccaccttatatataattatatattctaccataaatgctggccttcttcaaattatgattttggaaaatctaacccatacagagggataaaaaattgacatcccttggacaacttctccttgtttttttttgttttgttttgtttttaacattccaagctctctctggtcccctatccaaggagaaatgctagggcctcgaggatgtcgctatatatttttntaactaaatgataaatttntnttcaaatngttngaatncgtttccaaanctttcanagt

SEQ ID NO: 8320 - DNA, 308 bp, Homo sapiens
cctagagatcgttcagggtgttgtaactgggaacatctgaatgctgaggcttagtccagtgttctctctcccttaccactcctcttccccttccctctataatggcagtacccagggcccggtccatagactactatcgagtgctcctatgtgcatcttagtacgtatcattttcccttgcctttttccttctatcctttcagtggtagcaactgcccttgctaatcaccgtaacctcggctgagaaagaagaggaagcgaaatccaagatgcagctcagttcatcaaagcctagcaggtcccctcag

SEQ ID NO: 8321 - DNA, 556 bp, Homo sapiens
ctgtatacttactggtttagcatccctaatccaaaaacctataatttgaaatgtttcaataaacatttcctttgaatatcatgtgggcgctcacacagtgttggattttagagcatttcaaaattcgaatttttggattaaggattctcagcctgtaaacctagagttcttgactcaaatggactttcagtaccctttcctcaaccttcccacactcccgaccatacacatgtacctgcccacagacattcatacagtttccttattttaatgtcctgggaagaggtagaaacatcttgtcaaagtcactctttcagtggtgggcatctgcgctctaccatctggctgctcaaatgaaaatcgaaccttgcggaaaatttcctccacatcacaggaacaggcatattcttgcatatgttcaatgagtcttccaataaaaacagagcccattgtgggatgtctccaagaaacattatctggtgtggaagagcagaaagcgataaaatccttctctatgtgggctttcttaatagcatcatcctcaaactcttctgta

SEQ ID NO: 8322 - DNA, 192 bp, Homo sapiens
ttaaatgatgttttattagataaatttcaatcagggtttttagattaaacaaacaaacaattgggtacccagttaaattttcatttcagataaacaacaaataattttttagtataagtacattattgtttatctgaaattttaattgaactaacaatcctagtttgatactcccagtcttgtcattgccag

SEQ ID NO: 8323 - DNA, 494 bp, Homo sapiens
  misc_feature (1)...(494): n = g, a, c or t
gactcagactcctcatttgtaaattggaaatactttcgtatctttctaattcattgatgtgacaaactgagatagcacaaataaagcccttgcataaaacaattgatcaattaaatgtaactattgtaactatcaacattatcattttaaccaagtgaggtctgccaacaaggtattattacctccatttcatgaattaagacctgagcctcaaagcacttgaatgacttgcccacaatcacacaagtaaatggagacactggcttagactttggttttcactctcccagggagttcactgtcacatattgtgtgagttcatttaagcttctccaggagcctgctgatgatttctaaaaagtttatagagtccagaagaagactggggtctgacaatcccgtgagtagagaatgaatcagaaagaaatgtctanttttagttacagtcacttctgtggttccacaggctggaaaaatagcaattactttagtgt

SEQ ID NO: 8324 - DNA, 326 bp, Homo sapiens
ccagtggtgggttagaggcaggcaagggtgggagcagagatgggtgaatgggaggacatggggaaaccagtcagatggcatcacccattgggaggcagcatcttaccctttaaaaaacaaacatcagttgcatggaggaacagaaatattaagactatgtaatttaatctcaagaggttactagggtgtgctccaaatatattccgatgctgctgaaattaatcagaaagggaacagttcccagctactatcccatctgcctcaagtagaccaccctaattccttgatcctgtgcttcaagttgttagaaaaccattcaaaaaaag

SEQ ID NO: 8325 - DNA, 247 bp, Homo sapiens
cctctcccacttcgactgaggaggagcaggtgatgcttagaaatgaccaggacaccctcatggcccggtggacagggagaaacagccgatcttccctgcaggtggactggcacgaggaggagtgggagaaagtgtggctgaacgtggacaagagcctagagtgcatcattcagcgtgtggacaagctgctgcagaaggagcggctgcatggcgagggctgtgaggatgtcttcccctgtgcaggcag

SEQ ID NO: 8326 - DNA, 413 bp, Homo sapiens
ttggtcaccacagtgacagaaattgctggataagcgaagtgccactgggttctttgccctcccttcacaccatgggataaatctgtatcaagacggttcttttctagatttcctctacctttttgctcttaaaactgcttctctgctctgagaagcacagctacctgccttcactgaaatatacctcaggctgaaatttggggtgggatagcaggtcagttgatcttctgcaggaaggtgcagcttttccatatcagctcaaccacgccgccagtccattcttaaggaactgccgactaggactgatgatgcattttagctttgagcttttgggggttattctaccaacaaacagtccattggaaagaaaacagtccctggaattaacagatcagaatgttcacactggttaa

SEQ ID NO: 8327 - DNA, 426 bp, Homo sapiens
  misc_feature (1)...(426): n = g, a, c or t
ccggtgagttgggtgccggtggagtcgtgttggtcctcanaatccccgcgtagccgctgcctcctcctaccctcgccatgtttcttacccggtctgagtacgacaggggcgtgaatactttttctcccgaaggaagattatttcaagtggaatatgccattgaggctatcaagcttggttctacagccattgggatccagacatcagagggtgtgtgcctagctgtggagaagagaattacttccccactgatggagcccancagcattgagaaaattgtagagattgatgctcacataggttgtgccatgagtgggctaattgctgatgctaagactttaattgataaagccagagtggagacacagaaccactggttcacctacaatgagacaatgacagtgganagtgtgacccaagctgtgt

SEQ ID NO: 8328 - DNA, 178 bp, Homo sapiens
  misc_feature (1)...(178): n = g, a, c or t
ccaatgancatntcntacagaaggaccccgaaagaccaccagtccacagagaatgtgtacttcangccctgtangatctcaggggcgatatantcaggggtgccgcancaaggtgctggcccggctctccnngaatatnttntctttncacatcccaaanncggnaatctngatgtgg

SEQ ID NO: 8329 - DNA, 269 bp, Homo sapiens
  misc_feature (1)...(269): n = g, a, c or t
gtaatcccttccttttactacattttaattaccagggncacanaaatataaatggaaaaaaaacttantgccnganaaagtaaagcgngtatagacattctgttntatttaaaaataaatatcacctcttacaattagtgttgaatttttggaagacaatttgtgagactttcaaaatttattgtnncaatattagtattctgatngtaattttatatganagctttgcanaacgttaacattgggagaaactgggcaanntgtnaagg

SEQ ID NO: 8330 - DNA, 328 bp, Homo sapiens; identical to SEQ ID NO: 8110

SEQ ID NO: 8331 - DNA, 431 bp, Homo sapiens
  misc_feature (1)...(431): n = g, a, c or t
agctggtccagcagctcgagcagtgggagttccgagtctgtggagtttttcttgttgattctcagttcatggtggagtcattcaagtttatttctggcatcttggcagccctgagtgccatgatctctctagaaattccgcaagtcaacatcatgacaaaaatggatctgctgagtaaaaaagcaaaaaaggaaattgagaaatttttagatccagacatgtattctttattagaagattctacaagtgacttaagaagcaaaaaattcaagaaactgactaaagctatatgtggactgattgatgactacagcatggntcgatttttaccttacgatcagtcagatgaagaaagcatgaacattgtattgcagcatattgattttgccattcaatatggagaanacctagaatttaaagaaccanaggaa

SEQ ID NO: 8332 - DNA, 366 bp, Homo sapiens
  misc_feature (1)...(366): n = g, a, c or t
ccaacatggtgaaaccttgtctctactatttttacaaaagttagtcggacgtacagacgggtgcctgtagtcccagctacttgggaggctgaggcaggagaatttgtttgaacccagaggtgaaagttgcagggagccgaggttgtgccactgcactccagcctgggagacagagcgagactgtctccaaaacaaacaaacaaacaaacaaacaaaaaaaccctgtagcttgggatcagccttctcttctgntgnttttctttaaaaaataaaaattaaaaataggcttcaagtgatcctcccgccatgacctccaaaactgctgggattgtaggtgtgagcactgcacccagccgtatgtttttt

SEQ ID NO: 8333 - DNA, 395 bp, Homo sapiens
  misc_feature (1)...(395): n = g, a, c or t
ctggacaggttgattataccaaggcttgggaagagtactacaagaaaatgggtcaggcagttcctgctccgactggggctcctccaggtggtcagccagattatagtgcagcctgggctgagtattatagacaacaagcagcctattatgcccagacaagtccccagggaatgccacagcatcctccagcacctcaggtataattgccttcccagaccttccaccttaggttctgctgcaaaaagcaccagtgctgaagatgctgcaagcaccaaatcatagctcataaaatcaggtcctgagatagttacccataaagaggaatcctttgagtgtatgccattggtgagccgatgagcatggaccatanaagggctcaatgtagaaggtaaaat

SEQ ID NO: 8334 - DNA, 454 bp, Homo sapiens
  misc_feature (1)...(454): n = g, a, c or t
ctggtttcaaagatccccttctggcctctggaacagatggcgttggaactaaactaaagattgcccagctatgcaataaacatgataccattggtcaagatttggtagcaatgtgtgttaatgatattctggcacaaggagcagagcccctcttcttccttgattacttttcctgtggaaaacttgacctcagtgtaactgaagctgttgttgctggaattgctaaagcttgtggaaaagctggatgtgctctccttggaggtgaaacagcanaaatgcctgacatgtatccccctggagagtatgacctagctgggtttgccgttggtgccatggagcgagatcagaaactccctcacctggaaagaatcactgagggtgatgttgttgttggaatagcttcatctggtcttcatagcaatggatttagccttgtgaggaaaatcgtggcaaa

SEQ ID NO: 8335 - DNA, 346 bp, Homo sapiens
ctgactgtaacctccgcctcctgggttcgagattctcctgcctcagcctcccaagtagctgggattacgggcgcccgccaccacgcccggctaattttttgtatttttagtagagacagggtttcaccgtgttagccaggatggtctcgatctcctgaccttgtgatccacccacctcggcctcccaaagtgctgggattacaggcgtgagccactgcgcccggccacattcagttcttatcaaagaaataacccagacttaatcttgaatgatacgattatgcccaatattaagtaaaaaatataagaaaaggttatcttaaatagatcttaggcaaaataccag

SEQ ID NO: 8336 - DNA, 431 bp, Homo sapiens
  misc_feature (1)...(431): n = g, a, c or t
cactactgtgggttttactccttgccggatattgatccaaaagaataattgaagcaatgaaactatagaatttatctccaggatgtggtcagcacacaatattcatgcctcctttgttaaataagagacgtgttttccaagtctaatgttgccaaaaagactacgtcagtgctttctgtggaatggaactcttatttcaacagtaagtctgaatcatgaccatttatttatttaacagatattgngacaataaattatctgccaggaactgngcaatgcattgctaattcaaagacaagacatagaccctctcttacaggacttctctctctggaggagcananaggcttgtaaatatacnataagtaaaaacataacaagtntgattagagaggaatgcntaaggagttgtagaagcagggatagagana

SEQ ID NO: 8337 - DNA, 336 bp, Homo sapiens
  misc_feature (1)...(336): n = g, a, c or t
ctgggagaggagcagagccctgggatgagactgattgattcagaccagatggatggcctcacataggtgtgacaaaaatagtaacacattgcagacattccaggaactgtcctcttctcctggcctggaggtgggtcgcctgtgttgtctccttatctacctcttatgtgcttccgaatcaaagaatgtcaatgatgctaactcttttccatgttagcacctggtcacaaggcatcanacttgaagttccattaaaaaagtctaatgaccattgcccaagtttccctgtaggtaaagccaaagcaaatnntttngcctncngcctaaatatgtngt

SEQ ID NO: 8338 - DNA, 370 bp, Homo sapiens
  misc_feature (1)...(370): n = g, a, c or t
ccattgttgagcccagtgagagacatttctaccagccaatctggacactggtgggtgctggtgccnaacaattgncctcatctggtcgncccacggnaagtgtgatnccatctggtgtanaatggatcaaagctagagtgactgagttgaacccanacaanaactgcattcacacanatnacgacgaaaagatctcntaccganatnttattatngctcncggaatccanccacagcanctcggncctgagagcctgtcancccgtangtcngggcaaacaggttggcngcagncatcacatantccanatgcnggggattgttgacatcaaaggtgagcgggtgtggacagcntttgggcccngaccag

SEQ ID NO: 8339 - DNA, 230 bp, Homo sapiens
ctgcggaagcccagacaccaggaaggtgagatcttcgacacagaaaaagagaaatatgagattacggagcagcgcaagattgatcagaaagctgtggactcacaaattttaccaaaaatcaaagctattcctcagctccagggctacctgcgatctgtgtttgctctgacgaatggaatttatcctcacaaattggtgttctaaatgtcttaagaacctaattaaatagc

SEQ ID NO: 8340 - DNA, 525 bp, Homo sapiens
  misc_feature (1)...(525): n = g, a, c or t
caagacctttggaaagatgaaacctcgttatgaaatcaactccctgattagataccactgcaaagatggtttcattcaacgtcaccttccaactatccggtgcttaggaaatggaagatgggctatacctaaaattacctgcatgaacccatctgcataccaaaggacttattctatgaaatactttaaaaattcctcatcagcaaaggacaattcaataaatacatccaaacatgatcatcgttggagccggaggtggcaggagtcgaggcgctgatccctaaaatggcgaacatgtgttttcatcatttcagccaaagtcctaacttcctgtgcctttcctatcacctcgagaagtaattatcagttggtttggatttttggaccaccgntcantcattttgggttgccgtgctcccaaaacattttaaatgaaagtattggcattcaaaaagacagcngacaaaatgaaangaaaatgagagcagaaagtaagcatttccagcctatctaatttctttagnt

SEQ ID NO: 8341 - DNA, 486 bp, Homo sapiens
  misc_feature (1)...(486): n = g, a, c or t
gcagtgagccgagatcatgccgttgcaccccagctcaggtgacagcgtgagactctgatgcaaaaataaataaagaaataaaagaaaaggaagagagaaggcagcattagatggctgatgttatggcttcgtgaaacagtttatggcataaagaaataactccccaactccttagttttccaagtatgtaaatgtttctgctcatccaaacactagcataggtaagtgaggacacatatttcatctagcccaaatatattttttaaaagaatccctgcagattttttgcttctataaaaaatatcccaacccaaatttctaaaaattttgatttttggaattaaatgataatactaattancatttacctatacatccttttctattttaaaatcattgcataatctggcatttatatttaattttctaaatcattttccctagagagcattcatgtaattttagaacttggaaggaaccaggatt

SEQ ID NO: 8342 - DNA, 368 bp, Homo sapiens
  misc_feature (1)...(368): n = g, a, c or t
cctccaggcttctagagcagctagcttgggctggattctcacacccaggctgccccttggattgttctacccaagcttttccctggggtctgggctcactccataaggtaaggngccttttaccttatggtccttctttagcaggtaacaaaggagcatcaggggcaggctgccctggtggcatcacactggctagtgaggccgtgaatatcttgtcccccancagggccgacagtttctatcacagaaaacagtgtgttcagtggtgaaaatcgttgcatgcatgttttcatntgancgtgtccttctcccatactccctatcanccagccctgcctgtagctgntgtatggngattgcacttggac

SEQ ID NO: 8343 - DNA, 384 bp, Homo sapiens
  misc_feature (1)...(384): n = g, a, c or t
agaaaaagggccgttctgccatcaacgaagtggtaacccgagaatacaccatcaacattcacaagcgcatccatggagtgggcttcaagaagcgtgcacctcgggcactcaaagagattcggaaatttgccatgaaggagatgggaactccagatgtgcgcattgacaccaggctcaacaaagctgtctgggccaaaggaataaggaatgtgccataccgaatccgtgtgcggntgtccagaaaacgtaatgaggatgaagattcaccaaataagctatatactttggntaccnatgtacctgntaccactttcaaaaatntacagacagncaatgnggatganaactaatcgctgatcgtcagatcaaataaagttattaaat

SEQ ID NO: 8344 - DNA, 508 bp, Homo sapiens
ctaatatcataaataaggttgtttaagacgtgcttcaaatatccatattaaccactatttttcaaggaagtatggaaaagtacactctgtcactttgtcactcgatgtcattccaaagttattgcctactaagtaatgactgtcatgaaagcagcattgaaataatttgtttaaagggggcactcttttaaacgggaagaaaatttccgcttcctggtcttatcatggacaatttgggctagaggcaggaaggaagtgggatgacctcaggaggtcaccttttcttgattccagaaacatatgggctgataaacccggggtgacctcatgaaatgagttgcagcagaagtttatttttttcagaacaagtgatgtttgatggacctctgaatctctttagggagacacagatggctgggatccctcccctgtacccttctcactgccaggagaactacgtgtgaaggtattcaaggcagggagtatacattgctgtttcctgttgggc

SEQ ID NO: 8345 - DNA, 273 bp, Homo sapiens; identical to SEQ ID NO: 7855

SEQ ID NO: 8346 - DNA, 555 bp, Homo sapiens
tggagacgacattgaaaatgaaattcttatctctggacttacagggagaccccagagagagtcaaccccttctgggcactgtgattgatgggatgctgctgctgaaaacacctgaagagcttcaagctgaaaggaatttccacactgtcccctacatggtcggaattaacaagcaggagtttggctggttgattccaatgcagttgatgagctatccactctccgaagggcaactggaccagaagacagccatgtcactcctgtggaagtcctatccccttgtttgcattgctaaggaactgattccagaagccactgagaaatacttaggaggaacagacgacactgtcaaaaagaaagacctgttcctggacttgatagcagatgtgatgtttggtgtcccatctgtgattgtggcccggaaccacagagatgctggagcacccacctacatgtatgagtttcagtaccgtccaagcttctcatcagacatgaaacccaagacggtgataggagaccacggggatgagctcttctccgtctttggggccccat

SEQ ID NO: 8347 - DNA, 479 bp, Homo sapiens
  misc_feature (1)...(479): n = g, a, c or t
caagaggagatcggcgcggttgtcagctaaacctcctgcaaaagtggaagcgaagccgaaaaaggcagcagcgaaggataaatcttcagacaaaaaagtgcaaacaaaagggaaaaggggagcaaagggaaaacaggccgaagtggctaaccaagaaactaaagaagacttacctgcggaaaacggggaaacgaagactgaggagagtccagcctctgatgaagcaggagagaaagaagccaagtctgattaataaccatataccatgtcttatcagtggtccctgtctcccttcttgtacaatccagaggaatatttttatcaactattttgtaaatgcaagttttttagtagctctagaaacatttttaagaaggagggaatcccacctcatcccattttttaagtgtaaatgcttttttttaagaggngaaatcatttgctggttgtttattttttggtacaaccagaaaantagt

SEQ ID NO: 8348 - DNA, 487 bp, Homo sapiens
actaaacagccaatcatggtattcaaaggacaccgtaaagcagtctcttatgcaaagtttgtgagtggtgaggaaattgtctctgcctcaacagacagtcagctaaaactgtggaatgtagggaaaccatactgcctacgttccttcaagggtcatatcaatgaaaaaaactttgtaggcctggcttccaatggagattatatagcttgtggaagtgaaaataactctctctacctgtactataaaggactttctaagactttgctaacttttaagtttgatacagtcaaaagtgttctcgacaaagaccgaaaagaagatgatacaaatgaatttgttagtgctgtgtgctggagggcactaccagatggggagtccaatgtgctgattgctgctaacagtcagggtacaattaaggtgctagaattggtatgaagggttaactcaagtcaaattgtacttgatcctgctgaaatacatctgcaga

SEQ ID NO: 8349 - DNA, 275 bp, Homo sapiens
  misc_feature (1)...(275): n = g, a, c or t
gaaaagtcccggntttaggtttcagaaacagaattttcccgaatgtttaaaatggtgaatggttccataaactgtgttaaccaggcttcttacaggctagtcccagaatctgaccaccatgtgcaatactgtttctaagaaaagtgtgctccaagcaagaaccttcaaacatttaacctgaatgaatgaatataacctcttcacggntcanngttttcataagcaaaacanganaatagcancattgatgtcttttaaaaaaaanntanggctgg

SEQ ID NO: 8350 - DNA, 519 bp, Homo sapiens
ctggcattggtctagagctttataaggccattcagcgagggaccatcaagtgcaactttgcgggggttgccttgggtgattcctggatctcccctgttgattcggtgctctcctggggaccttacctgtacagcatgtctcttctcgaagacaaaggtctggcagaggtgtctaaggttgcagagcaagtactgaatgccgtaaataaggggctctacagagaggccacagagctgtgggggaaagcagaaatgatcattgaacagaacacagatggggtgaacttctataacatcttaactaaaagcactcccacgtctacaatggagtcgagtctagaattcacacagagccacctagtttgtctttgtcagcgccacgtgagacacctacaacgagatgccttaagccagctcatgaatggccccatcagaaagaagctcaaaattattcctgaggatcaatcctggggaggccaggctaccaacgtctttgtgaacatggaggaggacttcatga

SEQ ID NO: 8351 - DNA, 252 bp, Homo sapiens
  misc_feature (1)...(252): n = g, a, c or t
caccgtcctgctcttccagttcgggatgaatgcaagttctagccggtttttcctacaaggaatccagttgaatacaattcttcctgacgccagagaccctgcctttaaagctgccaacggctccctgcgagcgctgcaggccacagtcggcaattcctacaagtgcaacgcggaggagcacgtccgtgtcacgaaggcgttttcagtcaatatantcaaagtgtgggtccaggctttcaaggtggaaggtgg

SEQ ID NO: 8352 - DNA, 495 bp, Homo sapiens
  misc_feature (1)...(495): n = g, a, c or t
tgctcttcanatacctgacatagcaaggaaagagtgtgctgaaattggtagtacgttattctgcagttctgggcagcttctttcctgtagagttttggagcacatctctgaaagtggatgggtctggtgcctgcacacctccgtggttccttttcctgagctccagctgtggctgtctgtcagagaagcacatttttctgcagataattagaatggcttcccccatctctcacggactgtcccaagtctagaaaagaattgagttcctcttctattagtcaaataaaagggaagagaatgtttgtcttcctttcctttctgtagtgttaagaaaataaacgaacttaatgattctaaattatcagtgagcttaacactgtactatagaccaaagattaccttttcaaaaagtcctttgaggngaaatattttgtatacgtaatacatagatgcncatataaacacacacatatagaatctcaatattttaacact

SEQ ID NO: 8353 - DNA, 457 bp, Homo sapiens
ctgagcacaggccctgcagtacctacacttgacttccaagaagggaaggggttgtgtagaaatcctgcatcctcttggcatgtggaatgttctctaggtatccttattccccacagaagggactctaggtccaattctctgtcttatgactgctaccttaaggccaatgagggattctgactttgggtgggaatgaacttgggtttttccctttattcctcagttgacaggtatatacagctctgaaaccagagaaacctgactagaaaactgactgtctgaaagatgtttatcccataaagtcaaggtcgcattttccatttgaaggatagtaatattcttatatcttttgaaatcagtgcagctaaaactggcttacagtaatcttgttttctggctatgaaagattctaaaaggtgaaatataattgtttaaggagagatattgatggacctcg

SEQ ID NO: 8354 - DNA, 545 bp, Homo sapiens
  misc_feature (1)...(545): n = g, a, c or t
ttctgagagtggcgtggccctcacttctgttctggtgaagaaaggtgatgtcaagcccttggctgagcaaattgntatcactgctgggtgcaaaaccaccacctctgctgtcatggttcactgcctgcgacagaagacggaagaggagctcttggagacgacattgaaaatgaaattcttatctctggacttacagggagaccccagagagagtcaaccccttctgggcactgtgattgatgggatgctgctgctgaaaacacctgaagagcttcaagctgaaaggaatttccacactgtcccctacatggtcggaattaacaagcaggagtttggctggttgattccaatgcagttgatgagctatccactctccgaagggcaactggaccagaagacagccatgtcactcctgtggaagtcctatccccttgtttgcattgctaaggaactgattccagaagccactgagaaatacttaggaggaacagacgacactgtcaaaaagaaagacctgttcctggacttgatagcagatgtgatgt

SEQ ID NO: 8355 - DNA, 552 bp, Homo sapiens
  misc_feature (1)...(552): n = g, a, c or t
ccattctattgtggcaaggctgagtagaagatcctaccccaattccttgtaggagtataggccggtctaaagtgagctctatgggcagatctaccccttacttattattccagatctgcagtcacttcgtgggatctgcccctccctgcttcaatacccaaatcctctccagctataacagtagggatgagtacccaaaagctcagccagccccatcaggactcttgtgaaaagagaggatatgttcacacctagcgtcagtattttccctgctaggggttttaggtctcttcccctctcagagctacttgggccatagctcctgctccacagccatcccagccttggcatctagagcttgatgccagtaggctcaactagggagtgagtgcaaaaagctgagtatggtgagagaagcctgtgccctgatccaagtttactcaaccctctcaggtgaccaaaatccccttctcatcactcccctccaaagaggtgactgngccctgcctctgtttgacaaacctctaacccaggtcttgacaccagacctgc

SEQ ID NO: 8356 - DNA, 345 bp, Homo sapiens
  misc_feature (1)...(345): n = g, a, c or t
atanaaaactaaagaaattagataggctggaaatgcttactttctgctctcattttctttcattttgtctgctgtctttttgaatgccaatactttcatttaaaatgttttgggagcacggcaacccaaaatgactgaacggtggtccaaaaatccaaaccaactgataattacttctcgaggtgataggaaaggcacaggaagttaggactttggctgaaatgatgaaaacacatgttcgccattttagggatcagcgcctcgactcctgccacctccggctccaacgatgatcatgtttggatgtatttattgaattgtcctttgctgatgaggaatttttaa

SEQ ID NO: 8357 - DNA, 377 bp, Homo sapiens
cacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtgggagaacggtctcagaactgtttgtttcaattgg

SEQ ID NO: 8358 - DNA, 462 bp, Homo sapiens
  misc_feature (1)...(462): n = g, a, c or t
ccactgtgtagcaccttctaattcaatttcatcggcagttgtaataacagttccagcctcaggtgttttaatggtgggaaacatcttgattgcttctccagaaacttgaccataggttttgttttggaaatcttggagaatctcagttccttccacagcaataagttctgtgggagaagcttccatttcttctaataactcaggtttaccatcatcttctgaaggttctaattttgtgtcaggagataaagagggaggctcagttatgtgaaggtattcctcacttgatggtttgaaagtcgcttcaatatttacatgaatttccttaaaagaatcctgtggggacattacagatgagccgacgtctattcctggcagagcactgggctgggggatctctgtgtgtccagaggcttcactgcctgagtagatagtgaggggagatgatggtgtctganaaga

SEQ ID NO: 8359 - DNA, 564 bp, Homo sapiens
  misc_feature (1)...(564): n = g, a, c or t
ctgccacaaaccaggtgaagctttgttctaagaatatttgtttcatctagtttatgagtccaaatgatatagactgtaaatgtcacagcagtggtgaaagactgctcggtcatgagcaccgacagtaactcactggcacgtgaatttctgaccgatgtcaaccggctttgcaatgcagtggtccagagggtggaggccagggaggaagaagaggaggagacgcacatggcaacccttggacagtaccttgtccatggtcgaggatttctattacttaccaagctaaattctataattgatcaggcattgacatgtagagaagaactcctgactcttcttctgtctctccttccactggtatggaagatacctgtccaagaagaaaaggcaacagattttaacctaccgctctcagcagatataatcctgaccaaagaaaagaactcaagttcacaaagatccactcaggaaaaattacatttagaaggaagtgccctgtctagtcaggtttctgcaaaagtaaatgttttttcgaaaaagcagacgacagcgtnaaattaccca

SEQ ID NO: 8360 - DNA, 457 bp, Homo sapiens
  misc_feature (1)...(457): n = g, a, c or t
ccaaaaacctgcactcagaaagaggtgatgtttttaggagaaattgaagaaatcttagatgtcattgaaccaacacagttcaaaaaaattgaagagccacttttcaagcagatatccaagtgtgtatccagttctcattttcaggttgcagaaagggcattgtacttctggaataacgaatatattcttagtttgattgaggagaacattgataaaattctgccaattatgtttgccagtttgtacaaaatttccaaagaacactggaatccgaccattgtancactggtatacaatgtgctgaaaaccctaatggaaatgaatggcaagcttttcgatgaccttactagctcatacaaagctgaaagacaganagagaaaaagaaggaattgnaacgtgaanaattatggaaaaaattagangagctaaagctaaagaaagctctnnaaaaacaga

SEQ ID NO: 8361 - DNA, 186 bp, Homo sapiens
ccacagcggcccttcacctcagctccccgggtcaatgcgatatcggcctgttctgtgatcagatctacgtagttgctggcccacacatcataaggtacaataaatttggctgcaaactctgccatgagacacgtcgtcccattttcccgcaccacaaatatatctttttcagggttagtggaaagg

SEQ ID NO: 8362 - DNA, 509 bp, Homo sapiens
ccattaaaaagcaagatgaacctattgatctcttcatgattgagatcatggagatgaaacataaatctgaaactgatacaagcttaatcagagggcttgttttggaccacggagcacggcatcctgatatgaagaaaagggtggaggatgcatacatcctcacttgtaacgtgtcattagagtatgagaaaacagaagtgaattctggctttttttacaagagtgcagaagagagagaaaaactcgtgaaagctgaaagaaaattcattgaagatagggttaaaaaaataatagaactgaaaaggaaagtctgtggcgattcagataaaggatttgttgttattaatcaaaagggaattgaccccttttccttagatgctctttcaaaagaaggcatagtcgctctgcgcagagctaaaaggagaaatatggagaggctgactcttgcttgtggtggggtagccctgaattcttttgacgacctaagtcctgactgcttgggacatgta

SEQ ID NO: 8363 - DNA, 445 bp, Homo sapiens
cccttggaagggcccccctctgtttgataatcaacaaatctttccccatcataggaaaataaaagaatgaagcaatgcctggaagaagaactgaaatcaagaagggacctagaaaagctggtgcggaggcttttgaagcaaacagatgagtgtattcgaggcgagtccagtagcaagacctcaattcttccataaccatcactgtgccactgggtggagtgtgccttcagggcatcttgaaatgtcccgctgaatgatttgactcagtttgctcacttctttggcttttgttttgtgtttgagtctctctctctctccctctctcttctctttctctccccgctgtgtgcatatgtgtgtgcgtgcacgtgcgcgcttgggcatttgctgttgtttggttattggttggttgttcattttttttttcaacaggtgaaaaagcagg

SEQ ID NO: 8364 - DNA, 321 bp, Homo sapiens
ccaggctggtctcgaactcttggcctcaggtgatccacccactttggcctcccaaagtgctggggttacaggcatgagcgacctcatgggtgtagattttgcgaacagataaaggtagatgatattgggctgctttgttgtcatcatctattctattccctctccttgagaagttctcatgaaacacttatacctcgatgtgagtcaccttaaatcgttttgggatgcggcaagcaacacataagttaatagccatcatgacaacccctgaagacacctgggctttggcactgggagcgtggtccaagtatggtagcgagg

SEQ ID NO: 8365 - DNA, 466 bp, Homo sapiens
gtaaaagatttggtatattcagaatgcatgtgatggaacacacacataggagttatgaaccaaggtgcaattaatttagatcagaagccatatattccagatggtctgatgaaaaagccaattaagtataaaatgaaaacttgctcaaaaaggcaattaattttccgttttaatttaattatttattgtgaaagatatatagttgacagtatgttgacctgtttttttctcctttcttgttttataatgtcatatcttcctgacatatgtgtttctctataaaatttgaataattgcactaaattaaatcctgctagttttgggagaaaaatctagtagggttctttttctaaggtggtgattataacagttatgcatattcaatgaatattcaattctgcttttcaaaataacctattaagttttaaagagtaattacattagctatattcactagtaaacattt

SEQ ID NO: 8366 - DNA, 186 bp, Homo sapiens
ctgccacaaccgccatgaccccagtggcagggtcagtgcccacaagggggttgcctgctttgactgaactaacctgtgggtttagtccaacgaacagatgtgcctgatttcagggctgaatttttgcttgaccacaagtctcgggcagaacagattcgcctatgactgaatcgactgaatggatgg

SEQ ID NO: 8367 - DNA, 337 bp, Homo sapiens; identical to SEQ ID NO: 4598

SEQ ID NO: 8368 - DNA, 401 bp, Homo sapiens
  misc_feature (1)...(401): n = g, a, c or t
ccagcctggtctcgaactcctgatcttaagtgatccgcccatcttggcctctcaaagtgctgggattacaagcgtgagccaccgcacccagcagtaaaaataatactagtaattattaactacatttttaaaacatatgtgctctgagcaagactctgggccagggtctttcctgattattctcttgagtacttaccccagttctttgagttagacactaccgccctcatttttatgatgagttaagacagcaagtaacttgtctaagaacactcccttagtgaagtgtagagttaggattccaacccaatgtatgtgctgctgtgttatactttctaacactacaagtaacagcccanatggagagtgaggagggaggaaagcgttatttanggaccagg

SEQ ID NO: 8369 - DNA, 340 bp, Homo sapiens
  misc_feature (1)...(340): n = g, a, c or t
cgcgtcaggttataaatgaccctatctccttagttgtgtactctcgtgccaaaactgctggctgagtgtaccctttctgcaggaagtaaaaatggccttactaaataaatttatgttcaagtgctatttctttatggcaccggagaacaagcatttcaaacaatttggtggcaatccgtacggggatacattcttctctaggggcggtctccagtcctctctcatggggtagcgctcccctacttcattgcaaggtcctcataggtaagaaattgagacccacccggtgtgacgaataaacctgggctctcancaatgggggcaaaaaaaaaaaaactgg

SEQ ID NO: 8370 - DNA, 170 bp, Homo sapiens
gtcccgatcaaggtccagatcagttgacagtggcaattaaactgtaaataacttgccctgggggcctttttttaaaaaacaaaaaccacaaaaattcccaaaccatacttgctaaaaattctggtaagtatgtgcttttctgtgggggtgggatttggaaggggggttgg

SEQ ID NO: 8371 - DNA, 449 bp, Homo sapiens; identical to SEQ ID NO: 8036

SEQ ID NO: 8372 - DNA, 493 bp, Homo sapiens
  misc_feature (1)...(493): n = g, a, c or t
ccattatagtaatagtcataaatcaaaataccaaacagatctttatgaaagagaaaggagtaaaaagagagaccgaagcagaagtccaaagaagtccaaagataaagaaaaatctaagtatagatgaaagatgaagaggcagaattgagaggctaacatatttactcttgtctaacttaagagtgccaggaaagcagatgcttagattttgtgtcaaagcttgttatttttttcatactaggattatggtctttagattaatactgattatatagagcacggaaagataaagaattgaacattttctttgtatacttttttacactaattttattgttatacataaatggtagtcttcatttttgaagtcttacattttcactctttttttaatgaagtatttcatactacaaaaatacataaacgnatatataaagggataataaatgtaaatatctgtgtactcatcagncagcttaagatacagatgttg

SEQ ID NO: 8373 - DNA, 481 bp, Homo sapiens
ccaggtgcgcaccctgtggcatgaccctcgtcacataggctggaaagatttcaccgcctacagatggcgtctcagccacaggccaaagacgggtttcattagagtggtgatgtatgaagggaagaaaatcatggctgactcaggacccatctatgataaaacctatgctggtggtagactagggttgtttgtcttctctcaagaaatggtgttcttctctgacctgaaatacgaatgtagagatccctaatcatcaaattgttgattgaaagactgatcataaaccaatgctggtattgcaccttctggaactatgggcttgagaaaacccccaggatcacttctccttggcttccttcttttctgtgcttgcatcagtgtggactcctagaacgtgcgacctgcctcaagaaaatgcagttttcaaaaacagactcagcattcagcctccaatgaataagacatcttccaagcatataaa

SEQ ID NO: 8374 - DNA, 114 bp, Homo sapiens
cgcgtatgtgaacttccagcagccggcggacgcggagcgtgctttggacaccatgaattttgatgttataaagggcaagccagtacgcatcatgtggtctcagcgtgatccatc

SEQ ID NO: 8375 - DNA, 462 bp, Homo sapiens
  misc_feature (1)...(462): n = g, a, c or t
ctggtggttttcttcaggttccagcctctcttggcatctgctgccttgtttcctgtggaaacagcaagcagctctgcacggttcttctcatccttgccttgcagaagagcctgtttatttttgcctctgtcacttcctgaagaaatcagtgtattttcaatacagtgtggctcctttctcctaggttcagttaggtcgtgtttcctagcagtgtcactattcaagggttgagtccacgtcttgctctctggagaatgtcaatgtaatgtatttttcccatcgtacagagtctttgttgatttgcaaaatgttggatttggggttcatacccatattttttgttgtcatgggcatttaggtcatcantctgntctcttatttgcttgntcttttgttaattcattcccatggctatatgccagacacagcatgatgcanaaggaatacgacagaggatgacac

SEQ ID NO: 8376 - DNA, 368 bp, Homo sapiens
ccatgtaaataagatgatttaatgttgattttaatcctgtatataaaataaaaagtcacaatgagtttgggcatatttaatgatgattatggagccttagaggtctttaatcattggttcggctgcttttatgtagtttaggctggaaatggtttcacttgctctttgactgtcagcaagactgaagatggcttttcctggacagctagaaaacacaaaatcttgtaggtcattgcacctatctcagccataggtgcagtttgcttctacatgatgctaaaggctgcgaatgggatcctgatggaactaaggactccaatgtcgaactcttctttgctgcattcctttttcttcacttacaagaaagg

SEQ ID NO: 8377 - DNA, 497 bp, Homo sapiens
gtttgtgaaagatgtcttttcacctataggggagagactgggctgggaccccaaacctggagaaggtcatctcgatgcactcctgaggggcttggttctgggaaaactaggaaaagcaggacataaggcaacgttagaagaagcccgtcgtcggtttaaggaccacgtggaaggaaaacagattctctccgctgatctgaggagtcctgtctatctgactgttttgaagcatggtgatggcactactttagatattatgttaaaacttcataaacaagcagatatgcaagaagagaaaaaccgaatcgaaagagtccttggcgctactcttttgcctgacctgattcaaaaagtcctcacgtttgcactttcagaagaggtacgtccacaggacactgtatcggtaattggtggagtagctggaggcagcaagcatggtaggaaagctgcttggaaattcataaaggacaactgggaagaactttataaccgatacc

SEQ ID NO: 8378 - DNA, 329 bp, Homo sapiens
  misc_feature (1)...(329): n = g, a, c or t
gggagtagccaggctggatggctcaaatataaatgaatgaggaattctttatgaagtatcagtcagattttatgattaagtgatgtaatataggaattatgtaaaagggaagaatgtctgatactgatctattagagaggtactttagaggcttcttgattggcataaagttcctaaggttatagattttccccccttttggctgtatagcaaagtgttttaatccacggttgtgtcttattgttccattaaaattgtatcttcgatccatcaataaatacttgtggttgaatcaaaaaaaanaaaaaaaaaaaaaaaaaggcttgtac

SEQ ID NO: 8379 - DNA, 415 bp, Homo sapiens
  misc_feature (1)...(415): n = g, a, c or t
gaggtatggatggatgaatagatagatgatggatggatggaggggtaatgaatagatggatgacttaaactttagcaaaaggaattcatctggaaaatcataaaaggtgagtctgatgcataatataagtgtgaggaagaaatggaatctgagtctggagaggtacactagacagacagaagcagatgagtgaaactcttggatagcatctttcttcaaattccttgaatatattaaataataaatttggaattatagagccctcattggaagaatataaaatttcaaattaaaaaactagggcatatgcatatccaactgcttttttaaaaaagaaaagaaaaggaactaagggcaaaaacatggctgtcagctttctctntatcttctcaattcttttcaaattctancccac

SEQ ID NO: 8380 - DNA, 571 bp, Homo sapiens
ccaccaacagtttcccagccacatgctgggccctctaggtctctccagcccactctaaggacccaagaaatgcagccacagtccatctctcttttttctctccttccgggggaccaaggtaccttctggggcatacaacatggcagcagggcctcgggaagaggggtaggaggaccgagcagcattctctgtagaggaagacaggaaaggagaccctcttggcacacatttatggagggttgtccctgaagagaagggcaggtgggagaggttccctgttacttaagagaaggcaccagtggcaaagagcacaatgaagaggatgatgataaaaacaatcacgcagataaggacaatcatcttcacgttcttccaccagaattttcgagccaccttctgcgatgtcgtcttgaagtgctcagatgtggcttccagatcctctgtcttgttgcggagatgttccaagttttccccccgggccaggatccgctccacattctgggtcataatattcttaactccctccacctcactttgcaggttccgcacacgatcatttcctccaccttca

SEQ ID NO: 8381 - DNA, 204 bp, Homo sapiens
  misc_feature (1)...(204): n = g, a, c or t
ctgggatttcaaacagactgtcccattgtcaaacatttggtttgaaataaaaggactcttagtataactctgggccagaggggaagaaggggtgagggcagctagcgtggcaccctgggtccaactccaaccccttctgttgccagcaatgtgaccaaatacttacacctcccancaagtttctgtttctttaatgnaaatgta

SEQ ID NO: 8382 - DNA, 466 bp, Homo sapiens
  misc_feature (1)...(466): n = g, a, c or t
ccagcgacagcctggcctgggaatggactggcagctcatcactaaaatgactcctttcatggaatccactgttatgcagccacactgaccacagagcaactgaataggtgagcattggattgttgatgacaactcttcagcagaacaattgtgtgtttgaagggactgttttatgatgaaataactgttatttcctggagctaattgttgaatgacagtttgtcaactgtttaaatgaatttcatttgaattaacaattatacagccactcagaggtcctacattcgccagagttggcatccagttgatgggttcatttgaattaaatggtttggaggctaacgtgattttttaaattgaatttcatcactattctgtgtattctatttatcactattctaaatgactcatggttggctaattgattatcatgtaancaagctatttgaagaaattgattacatat

SEQ ID NO: 8383 - DNA, 255 bp, Homo sapiens
ccatgtcgtactactttgaccgcgatgatgtggctttgaagaactttgccaaatactttcttcaccaatctcatgaggagagggaacatgctgagaaactgatgaagctgcagaaccaacgaggtggccgaatcttccttcaggatatcaagaaaccagactgtgatgactgggagagcgggctgaatgcaatggagtgtgcattacatttggaaaaaaatgtgaatcagtcactactggaactgcacaaactgg

SEQ ID NO: 8384 - DNA, 182 bp, Homo sapiens
ccaatcaattctggaattacccacttgtttaattttgagcaacatgatctagcattaatgtaatcacattctaaatcagacaatgtaattatgaagtagaccgagaggaagatgagcgcgcaacaatcgaggagagagaagacgaacaccaccgcctccatcctcctcctccgtcgccgccg

SEQ ID NO: 8385 - DNA, 390 bp, Homo sapiens
  misc_feature (1)...(390): n = g, a, c or t
cctttatgttggggcctatgtggaaactctagccccgtgcttccattacatacaaaccgaatatattaaagctttagagtttttacaactatctatctttcccctgacatctccccagccaccttagaggtgggaaaggaaaggatataagaaaaccccactaaatgtggagtacatttcatcaaagtctgtgtgagccagcttgcccccagtcaccacgacgttgactgcatctcccgccttcaggtgcacgatgaggtggaatgcccccgggcccccgcaggtatgcaaagctcctggagggcggtggtattccaggaactctctcctgtacccagcggtatgcagacctgcccgggcggncactcgagccctatagtgagtcgtatt

SEQ ID NO: 8386 - DNA, 275 bp, Homo sapiens
  misc_feature (1)...(275): n = g, a, c or t
ctggtactctgcantggttttctctttgttgttcacaatcacagtacatttatatgtccctgagtcatagatccggacttcaggaataaaataactctctgtgctcttcatggaggagatgttgtaaaacagcacgtnatccttatagaanancatctggtgctgaggcttgacgtgagangtggtgctgacatccncgaancactgcanggtcaggttcttcccattttgcaccgtccngtccggnaggctcttcatgtcaacactgntgattg

SEQ ID NO: 8387 - DNA, 363 bp, Homo sapiens
cctctctcacctctcctactcacttaaagcccgcctgacagaaaccacggccacatttggttctaagaaaccctctgtcattcgctcccacattctgatgagcaaccgcttccctatttatttatttatttgtttgtttgttttattcattggtctaatttattcaaagggggcaagaagtagcagtgtctgtaaaagagcctagtttttaatagctatggaatcaattcaatttggactggtgtgctctctttaaatcaagtcctttaattaacactgaaaatatataagctcagattatttaaatgggaatatttataaatgagcaaatatcatactgttcaatggttctgaaataaactt

SEQ ID NO: 8388 - DNA, 334 bp, Homo sapiens
  misc_feature (1)...(334): n = g, a, c or t
tgacagantncaancaaataanatagngatgctggtcaggcttggnggctnatgcctgtnttccctaaactttgggagcctaaggngagaactccttgaactcctaaggccaggagttcaagaccagcctggataacatagcaagaccccatctctacaaaaaaccaaaaccaaacaaacaaaaatgatagtggtgcttccctcaggatgcttgtggtctaatgggagacagaacagcaaagggatgattagaagttggttgctgtgagccaggcacagtgctgatataatcccancgctatgggaggctgaggtgggtggatcatttgaggcc

SEQ ID NO: 8389 - DNA, 478 bp, Homo sapiens
  misc_feature (1)...(478): n = g, a, c or t
ccagcgacagcctggcctgggaatggactggcagctcatcactaaaatgactcctttcatggaatccactgttatgcagccacactgaccacagagcaactgaataggtgagcattggattgttgatgacaactcttcagcagaacaattgtgtgtttgaagggactgttttatgatgaaataactgttatttcctggagctaattgttgaatgacagtttgtcaactgtttaaatgaatttcatttgaattaacaattatacagccactcagaggtcctacattcgccagagttggcatccagttgatgggttcatttgaattaaatggtttggaggctaacgtgattttttaaattgaatttcatcactattctgngtattctatttatcactattctaaatgactcatggntggctaattgattatcatgtaagcaagctatttggaagaaattgattacatatatttatatata

SEQ ID NO: 8390 - DNA, 554 bp, Homo sapiens
ctgcaaagttaatagccagtatagtgtttggggaaacactataagctattaccaaaaaatcctctgtgagagggtgttagttggatgtcacataacataaatgatgtactgtgtggaagaacagttgttgtattgtgtattgtgggatttgtttttagatgaaaccgttaatgtatgtagtaggaattaacttttacataggtgaagtacaaatagagaagtgatagtgatttttttctctttatcaccaaaatcttatattgctaaagaatgaattttccctctcagaaaacactacattatcctaatttctttactttttaatcttgctattcaacagaaaaatatcctgttgcattcttcttttccaagtatgtcttaaataacggtagccccctgctcttccattttaactttagagtcagcatgtcatttgccattaacgaaaaccaaaacaaaacaaaaactaaagaaaaccaaactaagaggatatctacagaaatttcattgaatgtattaatgccagttactccacaaactggcctattattatt

SEQ ID NO: 8391 - DNA, 444 bp, Homo sapiens
  misc_feature (1)...(444): n = g, a, c or t
cttttttttttttttttttttttggaaacagggttttgctctgttgcccaggctggagtgcagtggtgcaatctcactgcagcctccacttcctggctgcaagcaatcctccaagcacagcctntcgagtagctgggactacaggcatgtgccacttgtctggctaattttattttttgtananatgaggtctcactatgctgcccaggctggtctcaaactactgggtttaagcgatcctcccacctnagcctcccaaaatgttgggattacaggcgtgagccaccatgcctagccggtaatctcttttttagtgaaaaaaattgaggtttanaaagtttaagtaacttgaccaaggtcgtacagctaatgagtaggagggcgagctggagctanaatccaaatcacagttctggtcttaaaacctccttatttccattaata

SEQ ID NO: 8392 - DNA, 474 bp, Homo sapiens
gggagatcagcactctctccccaatttatgttctcaatgggcatatgttgtttagaccaccaaaaatcaaggttagacatcctcagatgattgcaccaccctaaagccttacctccatttcaccgaaggagtcaccgccccccacaactgtcacacccaccagtgcaacccactactcatctctattactatccctacctctagcaactctaaccccaccttaggtgcttctatggtctaggagaaaatgccgttagaaaggactctacaggcttctttgaaatgcgctttgtttcttccccgctatcctctattgttaccccttccccaagcccatccaatcaaaccatctaccatttcatgcccaatgacaaaaccaaagtagttataataaaagtcaaggatttaaaacaaactttagccataacaactgggtaccaagatataaatgcctggctgaaatggattaaatat

SEQ ID NO: 8393 - DNA, 444 bp, Homo sapiens
  misc_feature (1)...(444): n = g, a, c or t
ccactagaggtctgtgtgccattgcccaggcagagtctctgcgttacaaactcctaggagggcttgctgtgcggagggcctgctatggtgtgctgcggttcatcatggagagtggggccaaaggctgcgaggttgtggtgtctgggaaactccgaggacagagggctaaatccatgaagtttgtggatggcctgatgatccacagcggagaccctgttaactactacgttgacactgctgtgcgccacgtgttgctcagacagggtgtgctgggcatcaaggtgaagatcatgctgccctgggacccaactggtaagattggccctaagaagcccctgcctgaccacgtgagcattgtggaacccaaagatgagatactgcccaccacccccatctcagaacagaagggtgggaagccaganccgcctgccatgccccanccag

SEQ ID NO: 8394 - DNA, 59 bp, Homo sapiens
  misc_feature (1)...(59): n = g, a, c or t
cggccgaggtcccccccccctttttttttttttttttttttttttttnttnagggaagt

SEQ ID NO: 8395 - DNA, 334 bp, Homo sapiens
cctaggcacagaggagcaggttagggcacattcaccttctcaggattctgtggctccctcattggagaagggagacagcatcttgggggcgcaattccaagagcagcgagggcagaggttagagatggctgagagcccctaacctgaggcggcaccacaataggcagcaacaactgtgtggaaagctggatgaactggtcagtagcggaaaatgggagggggcactgggttggcctcttggggaggggtccaaccttggcttggatgagctcatgagaatacccagtgttcccaagcagaggggggcagagcccaaagcccctttctctgcagg

SEQ ID NO: 8396 - DNA, 564 bp, Homo sapiens
ccagtggggcagcccttccccattggggtttccattgcgagcaaagttggcccagaatttcatcaccatcttgctaagtctgatctcctcttctgaggcaccctcttttaaaaatggggccccaaagacggagaagagctcatccccgtggtctcctatcaccgtcttgggtttcatgtctgatgagaagcttggacggtactgaaactcatacatgtaggtgggtgctccagcatctctgtggttccgggccacaatcacagatgggacaccaaacatcacatctgctatcaagtccaggaacaggtctttctttttgacagtgtcgtctgttcctcctaagtatttctcagtggcttctggaatcagttccttagcaatgcaaacaaggggataggacttccacaggagtgacatggctgtcttctggtccagttgcccttcggagagtggatagctcatcaactgcattggaatcaaccagccaaactcctgcttgttaattccgaccatgtaggggacagtgtggaaattcctttcagcttgaagctcttcaggtgtttt

SEQ ID NO: 8397 - DNA, 606 bp, Homo sapiens
  misc_feature (1)...(606): n = g, a, c or t
ctgtcagttctctaaacatttgcagcatcctactcagatctggagcatggaatacagtcttcagtttcttggaaaccatttttggctttttcagcctccagatctcactccatttcatgattccactcatgtcctgcagcagctccattgttgaccactgactccgacactccacatctgagatgagctctctcaccaactgcttctgctgaactagctcatcctcagcctctgcaaacttatccagcgtcttcttttcttcttcttccaatctttgcagctctctctgctcctcattatttaggatgcttctaagctgatcaaattctgtttgtatcctttgtctctcagtttgtacctgatacttccaggaagttttctcttctctgatgtcagcttccagcttctcagcttcctcctcttccttcttcagcctcttgaggactgcctggagtttctcctgacattccttgaatacttcctccgtgaggactgtgtggtgaccacggtgctcctganaccgctcacaaagccngcaaatgactttcctatcctccttacagaanantaggagtttctctccatgatgatcacaganatctctct

SEQ ID NO: 8398 - DNA, 372 bp, Homo sapiens
  misc_feature (1)...(372): n = g, a, c or t
gtctgaatgtggtgctttgcttctgtcctggttgaccctctgctgctgggccatcaaagtttggtgcatcttctgccaatcgcagacatagctgagcatacagngagctatactttggctcttctagggctttgtccacaatcagcagtatgacccctttaaggatgagtttagactctacacccacattgaggagctcaaggcatagcttgtcaaacttttcaggagtaagcttatttagtatgcctcttactttcctgaagattgcatcatgtcgttctttttcgtttgcggagttgtttgctgcggagttgtcatctcgtctagtgcttcgtgcaggaatccatttctgagcgttttgccctgnggttt

SEQ ID NO: 8399 - DNA, 570 bp, Homo sapiens
  misc_feature (1)...(570): n = g, a, c or t
cctccccttccccagcagttcgaggctcttcactcttccagatcccagagcttctgctctgttttactcctggtcaaaaatcccagcatccttctgtacctctcaaaagccctgtttttcgggaagctgcctccggactacttttgtttcccaggattttgaagcctgaataccagggcttacttgggagaatctgttctttggcttgaagaagcggaatcgagtgaaggagacagaaaaatagagtaacaatagagtgataagtgcttataccagtgacatacagggcctgtgggaacataaagctaaccaagcagagtgggtcgggggcctgctgaggccatttctctttttttttcttaattgacacagaattgtacatatttatggggtatatagtgatgttccgataaatgtaatgtattgngatcagatcaaggtagttagcatattcacctcaaacgtgtatcatttctttgngttgggagcatttaatatcctagctatttgaaactatatattattgncagctatagtcatcctacagtgctatagaacactagaacttat

SEQ ID NO: 8400 - DNA, 542 bp, Homo sapiens
  misc_feature (1)...(542): n = g, a, c or t
ctaaaataaaatttttttaatttttaaaaattacatttttatattatcttattagtatatgctcactgaggaagaaaacatttcaagcaatacagaaatgaatataaataaaatgttnaggttcttctcacctccctgttactcatagttgctagaggtgatcatttgaaaacgtggtaggctgggtgtggtggctcacacctgtaatccgagtactttgggaggccaaaaaaaaggaaggaggcttacttgaagccaggggttcaagaccaacctggcaacatagtgagaccccatctctgcaaaaaaaaattttttttaagtaactgccttttaatagcaaaataataccatcctaatctaaccacagagttaaaaaagaaagaaagtgtggtgtatatgattcagaccatttgttatctttatacaaaagtgactatgtgaaattctttgnttgtatttaagctaacgtgggattatattttacaaagtttttgtgaacttgcattttgtatttaccttgtctatagagcacagataca

SEQ ID NO: 8401 - DNA, 503 bp, Homo sapiens
gtttcattagagtggtgatgtatgaagggaagaaaatcatggctgactcaggacccatctatgataaaacctatgctggtggtagactagggttgtttgtcttctctcaagaaatggtgttcttctctgacctgaaatacgaatgtagagatccctaatcatcaaattgttgattgaaagactgatcataaaccaatgctggtattgcaccttctggaactatgggcttgagaaaacccccaggatcacttctccttggcttccttcttttctgtgcttgcatcagtgtggactcctagaacgtgcgacctgcctcaagaaaatgcagttttcaaaaacagactcagcattcagcctccaatgaataagacatcttccaagcatataaacaattgctttggtttccttttgaaaaagcatctacttgcttcagttgggaaggtgcccattccactctgcctttgtcacagagcagggtgctattgtgaggccatctctgagca

SEQ ID NO: 8402 - DNA, 358 bp, Homo sapiens
cctgtggggacgcagcagcatctctggagcggaggaagagagaggctgacacaaggctctccccctggggcggaagagctgccccagaagctgagaaacctccacaaaacaaaaacagtttgattccatccagcaactggtgacttattagctgcattgttttcaacatcacccctggcctgagctcaaatgtggctttattttgcaagcggctttgtgtgtggagacacatccggggttgataatgttgcagactgggatattttggttctttattgaaagggaagatcttactgccaccgggccccgcctcaccctccagattggaaactatgtgacccttacgatggggtcccag

SEQ ID NO: 8403 - DNA, 265 bp, Homo sapiens
  misc_feature (1)...(265): n = g, a, c or t
cttcactcagcaccttggcangatctgtgacggactcaggaagctgctagacgaagggaagctctgagagccctgagcctagcacattccaccttgacaaaatggttgactgagaaaacacagataatgggcttcctaaccctgctcacctggcactaacacttttcaatcttcaggcttcattccttcccaagagtgcttttgactctgagaccagcccacccccaaacagctagtggagaaggagcaatgctgaggggtgagg

SEQ ID NO: 8404 - DNA, 205 bp, Homo sapiens
  misc_feature (1)...(205): n = g, a, c or t
caaatcatttnacactgtttgtatcangngcttggcacaggaagatgccncanggtcaataaaatncagacaatattattacttaaatcctataaaacttttctgaggctggatgtggtggctcatgcctgtaatcccaacactttgggaggccaaggcaggaggaatgcttgagcccagganttcaagattagcctgggcaaaa

SEQ ID NO: 8405 - DNA, 358 bp, Homo sapiens
  misc_feature (1)...(358): n = g, a, c or t
ttcagccacctctctttttcagttggctgacttccacacctagcatctcatgagtgccaagcaaaaggagagaagagagaaatagcctgcgctgttttttagtttgggggttttgctgtttccttttatgagacccattcctatttcttatagtcaatgtttcttttatcacgatattattagtaagaaaacatcactgaaatgctagctgcaagtgacatctctttgatgtcatatggaagagttaaaacaggtgganaaattccttgattnacaangaaatgctctcctttcccctgcccccanaccttttatccacttacctagattctacatattctttaaatttcatctcagg

SEQ ID NO: 8406 - DNA, 391 bp, Homo sapiens
  misc_feature (1)...(391): n = g, a, c or t
ctgaggaacaaagtatcagaggagcatgatgttctcaggaagaaagagatggagtcagggcccaaagcatcccatggctatggaggtcggtttggagtagaaagagaccgaatggacaagagtgcagtgggccatgagtatgttgccgaggtggagaagcactcttctcagacggatgctgccaaaggctttgggggcaagtacggagttgagagggacagggcagacaagtcagcagtcggctttgattataaaggagaagtggagaagcatacatctcanaaagattactctcgtggctttggtggccggtacggggtggagaaggataaatgggacaaagcagctctgggatatgactacaagggagagacggagaaacacgagtccc

SEQ ID NO: 8407 - DNA, 383 bp, Homo sapiens
  misc_feature (1)...(383): n = g, a, c or t
tgcctgttggtcctgcangcggaaaccaaatgttggagcagtatgacaagctacaagatggcagcatcaaaatgaagcctctgatgggggtgatatacgtgcctttaacagataaagaaaagcagtggtccagggatgaattgtaaaagcaacatcagcttgaccagtataaaattacagtggattgctcatctcagtcctcaaagctttttgaaaaccaacaccatcacagcttgttttggactttgttacactgttattttcagcatgaaaatgtgtgtttttttagggtttctgattcttcaaagaggcacagagccaaattggnagaggaaggatgcaaagnataaatttgtgtaatattactttaacatgcccatatt

SEQ ID NO: 8408 - DNA, 497 bp, Homo sapiens
  misc_feature (1)...(497): n = g, a, c or t
aaggctaacagaaaagtgtttggacagtgggtgtcgagcagtactctaaacatgagtgaagccataaaagggttcctggtcaagtgctgtgcatacaattcccttggcacatcttgtgagacgatccttttaaactctccaggccccttccctttcatccaagacaacatctcattctatgcaacaattggtgtttgtctcctcttcattgtcgttttaaccctgctaatttgtcacaagtacaaaaagcaatttaggtatgaaagccagctacagatggtacaggtgaccggctcctcanataatgagtacttctacgttgatttcagagaatatgaatatgatctcnaatgggagtttccaagagaaaatttagagtttgggaaggtactangatcaggtgcttttggaaaagtgatgaacgcaacagcttatggaattagcaaaacaggagtctcaatccncgttgccgtcaaaatgctgaaagaaaaagcaga

SEQ ID NO: 8409 - DNA, 541 bp, Homo sapiens
  misc_feature (1)...(541): n = g, a, c or t
ccccatcaccactgncccgnggntgcctgtgtacctcttgccttttctgggcttgcntttctctcctctagtgggtggggatgactttcaatgactttcaatacttcccctgaaggaagaatgataaggagaaatgtctgttttgaggaaagggctttgaattccccanatactgaacaatttgtgtttgtgactgatggagaatttcaggaatgaatganaaagcctttgtgaaactatgcaacagtttacatcagtcatgtgaagtatttgtctaaaacagagcaaactgaagaccaaattattctcctgttgaggtccgtggatggcagatttaaagggaagaaccacaaaggcttgcaaagataggagaggctccatctctaatgcatgtanaagctccttacgggtgcccatcaagagcatagcttggaagccaccatgctgtgcggaactgcgtcagggcaaatgtcacagcaggatttccccaacccagctccatcatcacaaacncaganagctgcaggggaggacctcggcc

SEQ ID NO: 8410 - DNA, 433 bp, Homo sapiens; identical to SEQ ID NO: 8312

SEQ ID NO: 8411 - DNA, 379 bp, Homo sapiens
gagaaagccatgttcagttcgagcgccaagatcgtgaagcccaatggcgagaagccggacgagttcgagtccggcatctcccaggctcttctggagctggagatgaactcggacctcaaggctcagctcagggagctgaatattacggcagctaaggaaattgaagttggtggtggtcggaaagctatcataatctttgttcccgttcctcaactgaaatctttccagaaaatccaagtccggctagtacgcgaattggagaaaaagttcagtgggaagcatgtcgtctttatcgctcagaggagaattctgcctaagccaactcgaaaaagccgtacaaaaaataagcaaaagcgtcccaggagccgtactctgacag

SEQ ID NO: 8412 - DNA, 353 bp, Homo sapiens
ccagtggggcagcccttccccattggggtttccattgcgagcaaagttggcccagaatttcatcaccatcttgctaagtctgatctcctcttctgaggcaccctcttttaaaaatggggccccaaagacggagaagagctcatccccgtggtctcctatcaccgtcttgggtttcatgtctgatgagaagcttggacggtactgaaactcatacatgtaggtgggtgctccagcatctctgtggttccgggccacaatcacagatgggacaccaaacatcacatctgctatcaagtccaggaacaggtctttctttttgacagtgtcgtctgttcctcctaagtatttctcag

SEQ ID NO: 8413 - DNA, 505 bp, Homo sapiens
ccagtggaaatcatgccatatatggactccaaagttgacaatctgcctctgagttctggctctgcccatgggagaattcaattgaatatttttagtccttcatctccttatttgtaaatgggaagtaaaaatttatgccgtgcctatgtttcaggctggtaaaggatcaaataacatgatgccaacataagtgctttataaaatcttactatacttgaaaggtattcaatttttattcatcatttttacctacactgatttccagaaagaattttagttcagttacaacagaagatacataggcaataggaccgactattaaaacaaagataaaagaacaagaattatataataaaatagcagataattgtcccagaaaacctaagttaagcatagttgtaagagttgaacactaaatttagctttgaacttcctggcagctaagacagaacacaaaatacaattagacacaaaggtctccataatttacaaactgaagcatgct

SEQ ID NO: 8414 - DNA, 210 bp, Homo sapiens
ctgatccacgaggaccttcttgaggacatttgggaagcctcggaggccagacgcagggaataggcggtccagcgacaagtaccagtagtgcaggaagggacccatgctgcagcccaccgcaaacatgctcgctataagagtgtaagtcagggggctgggtcgggccggcaagttcctcagtccattccctctctccctccctggctaagg

SEQ ID NO: 8415 - DNA, 504 bp, Homo sapiens
  misc_feature (1)...(504): n = g, a, c or t
ctggggcttgtttagcttccagcacactctcagtcatagcatgtgtagctaaaggaagtaatgggaaggggttcatgttctctttataatgcagtggcnaaaggttctgaaagccttttaaactcgaaccagtgggggaaagatggatcttgaagctaatcctgcanagagttttatngaggccanggattgccttctaaattatgataaaacanaagtgaagagtttcanagcatcagattgagtgaaaagttgtcagattctgtattttttaacaatcttcaataatgtaaagattacttttaaaatatttaagttnaaactacttgaatagtattttgctgaagagcaagatatgcattaatcaccggttttatactgtccaaaatgaagcatccccgtgacaaaccanagtgggcagaagcatcnnanagcgtgacaggaaatcccaagactgcttccgcctcanaggcgtnccggctgcgattcgctgccctgttgtca

SEQ ID NO: 8416 - DNA, 399 bp, Homo sapiens
  misc_feature (1)...(399): n = g, a, c or t
tgattgtanctntgttggngtatntcgtgtncaagatggaaaagtgcttttgttgttctacctgatccagttgggggagcangaatngggggtgcctgnctaacggcctctagcccatgtgcttatactgggatctgtcccgagggatctgcacctggttggcantcattttgtggtgngacgtggtaaatcncgagtgttaccatgatgacgaggcccaagatgagccccaaaatcangggcaaggtttcttccagntgntcccgctcatncactgggcattnatgctcttcactgaagacaaaatntganataatgnnaaaaggntggatgtggaccncananaggatcatggggaccgtcttctgcggatcactacaggccaatgaaatggtttgt

SEQ ID NO: 8417 - DNA, 473 bp, Homo sapiens
  misc_feature (1)...(473): n = g, a, c or t
ctggcattggtctanagctntataaggccattcagcgagggaccatcaagtgcaactttgcgggggttgccttgggtgattcctggatctcccctgttgattcggtgctctcctggggaccttacctgtacancatgtntcttctcgaanacaaaggtctggcanaggtgtctaaggttgcanagcaagtactgaatgccgtaaataaggggctctacagagaggccacanagctgtgggggaaagcagaaatgatcattgaacagaacacagatggggtgaacttctataacatcttaactaaangcactcccacgtctacaatggagtcnagtctagaattcacacanagccacctaggccaggctaccaacgnctttgtgaacatggaggaggacttcatgaagccagtcattagcattgtggacgagttgctggangcagggatcaacgtnacggtgtataatggacag

SEQ ID NO: 8418 - DNA, 353 bp, Homo sapiens
  misc_feature (1)...(353): n = g, a, c or t
ccttctctgcttcagtcntgttcttcangatagtgtacatgcnnccaatgttgaagcaaatccgggagtgggggtcctggacggnactgaaggcatccagggctcccttccagtccttnttgtccgctgccagcaccccttcattccagagnctgatggcctccaccagggacatgantaggtagaaactaggaggccaanagagctgccngganacagagagaagacaggttggagcgtctcccctagcagggctgccttantggcccccaaggtgttcactttctgggccagatgagtagaatggggcccagcctcccttaaganaacttctcagtgttgcaaatgcatca

SEQ ID NO: 8419 - DNA, 496 bp, Homo sapiens
  misc_feature (1)...(496): n = g, a, c or t
tcgacgccaggagaaaggggggaggagaagccgttggatggacaggaacacagggagaggccggagggggaaacaggggatttgggcaagagagcagaagatgtaaaaggtgaccgggagcttcgaccagggcctcgagatgagccacggtccaatgggcgacgagaggaaaagacagagaagccccggttcatgttcaatatcgccgatggtggcttcacagagcttcacacactgtggcagaatgaggaacgggcagctatttcctcggggaaactcaatgagatctggcacagaagacatgactattggcttctggctgggattgtcctccatggctatgcacggtggcaggacatccanaatgatgctcaatttgccattatcaacgagccatttaaaactgaagccaataaggggaactttctggagatgaaaaataagttcctggcccggaggttcaagctcctggagcaggcgctggtgattgaggagc

SEQ ID NO: 8420 - DNA, 208 bp, Homo sapiens
  misc_feature (1)...(208): n = g, a, c or t
gaatnaagcactttgtctgatggtcaanctattgcagaccanagtgaaatnataccaacattnggccaatttgaaaggactcaggaggagtatgaatacaaaaaacatgctggtcctncntttcaaccagaattntcntcaggagctgaggaggcattnatagaccatactccctatctaagtattgctactacccaccttatggatc

SEQ ID NO: 8421 - DNA, 313 bp, Homo sapiens
ccggacccggagccgccatgcccaagtgtcccaagtgcaacaaggaggtgtacttcgccgagagggtgacctctctgggcaaggactggcatcggccctgcctgaagtgcgagaaatgtgggaagacgctgacctctgggggccacgctgagcacgaaggcaaaccctactgcaaccacccctgctacgcagccatgtttgggcctaaaggctttgggcggggcggagccgagagccacactttcaagtaaaccaggtggtggagaccccatccttggctgcttgcagggccactgtccaggcaaatgccagg

SEQ ID NO: 8422 - DNA, 471 bp, Homo sapiens
  misc_feature (1)...(471): n = g, a, c or t
cctttctctatatcacctttctggaaatcctgccccaggagctggccagttctgancaaaggatcctcaaggtcattctgctcctagcangctttgccctgctcactggcctgctcttnatccaaatctagggggcttcaagagaggggcaggggagattgatgatcaggtgcccctgttctcccttccctcccccanttgtggggaataggaaggaaaggggaagggaaatactgangaccaaaaagttctctgggagctaaagatagagcctttggggctatctgactaatgagagggaagtgggcagacaagaggctggccccantcccaaggaacaagagatggtcaagtcgctngagacatatcaggggacattaggattggggaagacacttgactgctagaatcagaggttggacactatacataaggacaggctcacatgggaggctggaggtgggtacccag

SEQ ID NO: 8423 - DNA, 332 bp, Homo sapiens
  misc_feature (1)...(332): n = g, a, c or t
aggccacctggattgcgcctaatgtgtttgagcatcacttaggagaagtcttctatttatttatttatttatttatttatttgtttgttttagaagattctatgttaatattttatgtgtaaaataaggntatgattgaatntacttgcacactctcccattatatnntattgtttattttangtcaaacccaagttagttcaatcctgattcatatttaatttgaanatagaaggtttgcanatattctctagtcatttgntaatatttcttcgtgatgacatatcacatgtcagncactgtgatagangctgaggaatccnanaaaatgg

SEQ ID NO: 8424 - DNA, 379 bp, Homo sapiens
  misc_feature (1)...(379): n = g, a, c or t
aggagtaccataattntggtagctaaatatatattttanatngatgaagaagctagaaaacaggcanattcctgactgctagtttatatagaaatgtattcttttagtttttaaagtaanggcaaacttaacaatgacttgtactctgaaagttttggaaacgtattcaaacaattngaatataaatttatcatttanttataaaaatatatancgacatcctcgaggccctagcatttctccttggataggggaccanagagagcttggaatgttaaaaacanaacanaacaaaanaaaacaaggagaagttgtncaanggatgtcaattttttatccctctgtatgggttagattttccaaaatcataatttgaaga

SEQ ID NO: 8425 - DNA, 282 bp, Homo sapiens
gaggcacaaggcacaacaggctgctctgggattctcttcagccaatcttcattgctcaagtgtctgaagcagccatggcagaagtacctgagctcgccagtgaaatgatggcttattacagtggcaatgaggatgacttgttctttgaagctgatggccctaaacagatgaagtgctccttccaggacctggacctctgccctctggatggcggcatccagctacgaatctccgaccaccactacagcaagggcttcaggcaggccgcgtcagttgttgtgg

SEQ ID NO: 8426 - DNA, 389 bp, Homo sapiens
  misc_feature (1)...(389): n = g, a, c or t
ctggtgtcaagacctgggttagaggtttgtcaaacagaggcagggcccagtcacctctttggaggggagtgatgagaaggggattttggtcacctgagagggttgagtaaacttggatcanggcacangcttctctcaccatactcanntttttgcactcactccctantngagcctactggcatcaagctctagatgccaaggctgggatggctgtggagcaggagctatggcccaagtngctntganaggggaagagacctaaaacccntagcagggaaaatactgacgctnggtgtgaacatatnactntcttttcacaagagtcctgatggggctnggctgagcttttgggtactcatccctactgnntatagctggagaggatt

SEQ ID NO: 8427 - DNA, 392 bp, Homo sapiens
  misc_feature (1)...(392): n = g, a, c or t
catgctgnncctgtcctggcctcaagtganccacccacctnnncctctcagtgttgngnttataggcaaccgnncccggccaaatccattntcatcactnaatgtttaaaggctacgttcagtttcctatangtgatattgntaggatctactancaaatganttggtaacctnacatctttgnattcatgtcnaaaaaaattcttttataagaacaaaaatggtactcttagcctcattcactggagtattactgaaaagcatgatattcttactctattttgggtacattatgacagagaggntattattacnanctgtcagnanaactnaggcttcttgagtaanggggattgaggnaaacntttggaanctggtgaatacatttcaag

SEQ ID NO: 8428 - DNA, 321 bp, Homo sapiens
  misc_feature (1)...(321): n = g, a, c or t
ctggcttccnagaggcaattctgtccttggaagccaggtttgaccatctgtaatcagccttgtgagaagtctcgtttgagggggccagggatggaacgggagggcgcatatcgtatgaggtatgggcattgtgttaagctgggggaagttgcagcttgtcctgaattacatggagaggaataaagtgggtgagtaggaggagccatttcatctgaaagcctgaggcccctctggtcccctcgataaaccccactggtgtcccaggccacaggtaacaggagaatagacatttaatgtcacagaatgtcagagcaggcaagg

SEQ ID NO: 8429 - DNA, 383 bp, Homo sapiens
  misc_feature (1)...(383): n = g, a, c or t
ccatggacaagctgaggaagatgctggttccctgcccacagaccttccaggagaatgacctgagcaccttctttcccttnatntttgaagaagaacctatcttcttcgacacatgggataacgaggcttatgtgcacgatgcacctgtacgatcactgaactgcacgctccgggactcacagcaaaaaagcttggtgatgtctggtccatatgaactgaaagctctccacctccagggacaggatatggagcaacaagtggtgttctccatgtcntttgtacaaggagaagaaagtaatgacaaaatacctgtggccttgggcctcaaggaaaagaatctgtacctgtcctgcgtgttgaaagatgataagcccactctacag

SEQ ID NO: 8430 - DNA, 476 bp, Homo sapiens
ctggcattgtggcagtgctaaagcagcgccccagattggtggctgcagcagtccaggcattttacctacgagaccctattgacctgcgagcttgtcgtgttttcaagacattcttgcctgaaacacgaataatgacatcggtcacattcactaaatgtctatatgcacaattggtgcaacaaaggtttgtgccagaccggcggagtggatacaggctgcctcctccatctgatccccagtaccgagcccatgaattgggcatgaaattggctcatggatttgagatcttatgctccaaatgtagcccacatttttctgactgcaagaaatcccttgtgactgcctcaccactctgggccagtttccttgaaagtctgaaaaagaatgattactttaagggactgatagaaggttctgctcagtaccgggaaaggctagaaatggcagagaattacttccagctctcagtagactgg

SEQ ID NO: 8431 - DNA, 495 bp, Homo sapiens
ctgttagggctgaatcttctggagaaaaaggtgccatctcaggagaatagcttttactctggtaggaatgcttccgagacaccacaaggcagcctgaacactcagttgcagggtcgggcttgcggtgggtgacccagagccaccaaagtcacatccacaactaatgagggaaatctgtaaagccagttagatagaagaattttatttttctgtgggttttgtgttgtcttttttatgttaaaaagaaatccagtttgtgtttttctatagaaaaagtaaaagatcaggttatactttaggttaggggttctatttattcctgttagtaaataaaattaacaaatttctttgtttaacaaaagattaatctttaaaccactaaaatacatagactgattgattattcaacacattggaattgatgtcggtcatagtttcctgaagcatttagttacaacctgaaggaataaaatgatttgtggaaatgcttaaaat

SEQ ID NO: 8432 - DNA, 383 bp, Homo sapiens
ccatggacaagctgaggaagatgctggttccctgcccacagaccttccaggagagtgacctgagcaccttctttcccttcatctttgaagaagaacctatcttctttgacacatgggataacgaggcttatgtgcacgatgcacctgtacgatcactgaactgcacgctccgggactcacagcaaaaaagcttggtgatgtctggtccatatgaactgaaagctctccacctccagggacaggatatggagcaacaagtggtgttctccatgtcctttgtacaaggagaagaaagtaatgacaaaatacctgtggccttgggcctcaaggaaaagaatctgtacctgtcctgcgtgttgaaagatgataagcccactctacag

SEQ ID NO: 8433 - DNA, 460 bp, Homo sapiens
  misc_feature (1)...(460): n = g, a, c or t
ccagatttctgaagaaacatggaattttctgcagtttatttatggtggagggcctgaagttatcctgcgacctccggttgttcatgttgatccagatatacttcaagcagaagaaaaaattgaagtagaaactcggtctttgtaatttttaggatgtagagagttctaatgaggaatcattttcatgtgccctgacatgtacacatgcgaaaacattcctaaaagcgtgtttatttgctttattttttttcatcatttatcccatttatttcttcttagtgggcattatggaagaatatattaaaatgtgtaatataccacaggttggtatatttagttttaaatacttaccataaagtctttcagtgtaatttttttttgagacagagtcttgctttgtcacccaggctggagtgctgtggtgttacctcagctcactgnancctccacctnctgggtt

SEQ ID NO: 8434 - DNA, 482 bp, Homo sapiens
  misc_feature (1)...(482): n = g, a, c or t
ccaatatgcctttggagcacagcctatggtttatgtttcttttatgaccacctttaatatctgtcaaacgactagacatgctatagctttacccgaaggtaatttgattgactgtgctctgctagaagatggtgtatgggtccctctcgaggtaactgccaataaatgataagtggtatttgttttanataatgcctctacctnagtggtagctttgataatggcaaattgtaattgcaagtgccattttcanaataggcattggtttattttaggaagaggataataaagttccttttagttatcaaagtaacaccttttattgntaaatctcaacttttgaagaaaacactttcaatttcttaactttttcctcagggttagtgagttagtacaactacccaaagaagtgttaaaatattganattctatatgtgtgngtttatatgtgcatctatgtattacgtatncaaaatatttca

SEQ ID NO: 8435 - DNA, 411 bp, Homo sapiens
ccttattattattattattttttttttgctgacaagtccaagatggcagtcggaactctgacccataaaaccagaaggcttagatgaagaacaaaaagaagggaaaccaaccctgcttccttttgcctgttattaatcgctgcaataaagccattagaatctaccaacatatcacccaacttgaaaagaagagagattctgaaaaatagtcagaaaagaagggtaaatggaaatgatgagtccctcccctttatggctattttaagaagcacaccatgttattcatatggcccgtgcttagcccactccctgaattgtttgattttagtggatataaaaattcttcctaagggctttcttagttccactgccagcagtagttccccatttctatttctcgttaggtctcaa

SEQ ID NO: 8436 - DNA, 430 bp, Homo sapiens
  misc_feature (1)...(430): n = g, a, c or t
aaataggaantattttaatgtttcttggggaatatgttagagaatttccttactcttgattgtgggatactatttaattatttcactttagaaagctgagtgtttcacaccttatctatgtagaatatatttccttattcagaatttctaaaagtttaagttctatgagggctaatatcttatcttcctataattttagacattctttatctttttagtatggcaaactgccatcatttacttttaaactttgattttatatgctatttattaagtattttattaggagtaccataattctggtagctaaatatatattttagatanatgaanaagctagaaaacaggcaaattcctgactgctagtttatatagaaatgtattcttttagtnnttaaagtnaangcaaacttaacaatgacttgtactc

SEQ ID NO: 8437 - DNA, 390 bp, Homo sapiens
  misc_feature (1)...(390): n = g, a, c or t
tgttttctaagtcctctcccctaataaaacctacccaacaatagtgctttnaaaagtggtannttatcttgaagatactctnnccaaatgcaaagataaacattctttttgtctgctttataaatatgaaatatgccagatctatantatnttaatgtgcatctactttaaatnagtcatcttgnggtttttataattcccttatgttcttgcccctctncacttgaaataacaaaatgccttaattttatggattagttctcttatagnanacaggcagctatatncagcaaaaccaataaagttatnttncaactttnatagttgnaaaatntcttataacaggaatacaaaacagctangnaaacatgccacattttattttagcat

SEQ ID NO: 8438 - DNA, 436 bp, Homo sapiens
  misc_feature (1)...(436): n = g, a, c or t
cctggctcaacaaaagggctggggattggccctgaaaggagagagctgactgtcctggctgatggacaggagatcctcttagcactaccctaaggcaggcagttgggcattggtgtagacaacaggaaagtccaggctatagccgtactcaaaaacctttctgttccctttctgccagccctagggattgagtccacattcagcacaggactctctgggtacagctctctttaggaagacacaaattgcatggtgaagtcagttatatcctggccgcctttggtccctcccaggaagacgggcatgttttctgcttgagaggtgctgatgtaccagttggggaactgggcagactcaaattccagcttgntattgatttctatcttgttgaagacaaatcgcttttccatcttcttctttgggtaatttttgggat

SEQ ID NO: 8439 - DNA, 310 bp, Homo sapiens
gaaaaaatatataataagtacataaaactacacaaatgtttgcatttcaggattatgaattataagtcagtttgttacttcaccatagcaagatgttgtgaatccactaaaatgttctttatggggattgtaatttaaagactgaagagcaggaacgatcactggttacaactgtatgacgtggactggacaaagactcgagattaatatccaaaaaggtttatagatgggtttgaataatagataatgggtcatttttataacattttacaataattaattttatttcatcttttaatgtggggggtgg

SEQ ID NO: 8440 - DNA, 313 bp, Homo sapiens
  misc_feature (1)...(313): n = g, a, c or t
aaacaatgaggggagagaatgagggacagagagaggaggggactgaggggccaaggaggttccgatgagcaaaaatggaagagaaagaacgtcagagaggangctattgggggatgaggagagagaccagagatcaagaagcatgaaggtattgagggccanagaggggacttctagggacatggagaggctgcaggacagagaaagggctcggggaacgggacagtggttctttcatttcaatgatcaaagttcccagctttttgacaccacaggggcaccctgacaattctggcaataagaacatgaaagg

SEQ ID NO: 8441 - DNA, 481 bp, Homo sapiens
  misc_feature (1)...(481): n = g, a, c or t
ccttggcctggccttgactttgggaaccttggaaatctttgggccttgactttgggaatcttggctgtggctgggagaaagctgggtggtcttggaggatgagcagaggtgacaggcttgggtgggaccgtttgaacatccttcctaaccagtgccttccccggcacagactggacttcgacattgtccggcgaagcagtgggtggtgtctggcagcgacttgggagatcatttcccgatgacatcacagtgtggtgttttctcttggatgcaaaccacactcttcacttggcttcaaaacagcttaagcgagcgaacagagactaggagggaacggaaactgtccgagcaggcgggcgggggcggcttangatctgtagtcctttttgctgtagggtttattgcccaaaatactatcaatctcgtggataatggaagacgacagtttcggaaggacctgtattgccccaatgttctccat

SEQ ID NO: 8442 - DNA, 467 bp, Homo sapiens
cctggacctgtgtaaaccttcaaacactcttttttacattaggtcatgaagttaaattttttactgtttctgtgctacagactcttcaaaggaaaatagttaagtcaatttcaaagaaaatgaccagcacatttttaaaacattagaaatgatttgactttgactatctactgccaaaaaaaggttaaggaatttgtaatgagaagctaaaaactttaaggaattttaaggaactcaaaacaaaaactcattaaatgtaattaaagtgaattctacaaataaagtctcttaatacatttctataatagtcacttaagacttaaattcaaacactagcaaaccacaaaatcagactgtatgactgacatccaaaagataaatataaatcaaaatccgaccccagcattagccaaggggtaggtgttcctcttgaggaaggcaggaattcctcttctgccacctgttgg

SEQ ID NO: 8443 - DNA, 391 bp, Homo sapiens
cgagatcgtaccactgcactctcgtctgagcgatagagtgagactctgcctcaaaaacaacaataacaaaaagaaaaacctgtgaggttgtaggttctttcccctttttcctttcctttttttttccccctttttcctttttcctttcctttttctctcactctgtcacccaacctggatgggagtggagtgtagtggtgtgatcatggcccactgcagccttaacttccttggctcaagtgatcctcctgcctcagcctcctgagtagttgggacaacaggcatgcactaccatgcctggctaattttttactttttgtagagacagggttttgccatgttgcccgggctggtctcaaactcctgggctcaggagatccacccacctagg

SEQ ID NO: 8444 - DNA, 430 bp, Homo sapiens
ccattcctgaatctatatttggcaaagccattctattattaacactgtaacatactgcattcaaatctaacctttgactttctcaaacgtatccctttatctcaactttacattattctgtgaaatattagacaagtagagaaaaggaaacagacccagaagttttgattcagtgatactgacccaatacacaccgtaaagttgtacagcaaaaactataactagttaagatcactcccaattttttgctcattcgcatataatacttaatatcctaaaatattgctaaaattatttaaggtagtatttataaggctattcctataaagtgttggcattttataaaatacttcagatttgaatattcctcaatctccgtgtccatccagctcttcttactcatgttaatttctctctagactctttgcag

SEQ ID NO: 8445 - DNA, 273 bp, Homo sapiens
ttttttttttgaactaaaaaagaactttatttattgagggcaaggggatgcaaacaatacaaaaatcaaaagcttatctggtatttaacttttctttctctgcttgtcaaatgagagttagattttatttttacatttgctaagtgtcctgatctgctcatgaaatccttctatgggggaagctgtggggcagattccttaagcgaccctttgggacaactcttatcagggaggagcgaactgctcatttctgcctacttctttcccttctgc

SEQ ID NO: 8446 - DNA, 510 bp, Homo sapiens
  misc_feature (1)...(510): n = g, a, c or t
ccttggctgcaggaacagactttttccatcggcttttccagggcccaggtgaagaggccacttcagcaacagagggtacaggagagagtttaggggctggtggagattaaagtgggataagtgtatctaaatagacttatgtacactaaaccaatgaaggagaggtttggctttaagaaataaatatgcccccaaccccagaaaccaagctgctgagtaggttccacaggcgagatacacatttaacactcaccccgggccagtacacttgactggnttaattntagtacatctgtcatcactatacactgagtagaatacagtggataagcaaaggtttctccaccatggagagagatttgtgttgccacaaactgtttctgtcacccacccgtgtggggacttctgagaaagttttcttgttccaagganccatgtgactcancgcgaggccctgcctcagcagaagctctgagccagaagccacatatattgctggagacaacatgg

SEQ ID NO: 8447 - DNA, 492 bp, Homo sapiens
  misc_feature (1)...(492): n = g, a, c or t
ctgtctgtactanacaaggttaccaagtgcngaattggttaatactaacagagagatttgctccattctctttggaataacaggacatgctgtatagatacaggcagnaggtttgctctgtacccatgtgtacagcctacccatacagggactgggattcgaggacttccaggcgcatagggtagaaccaaatgatagggtaggagcatgtgttctttagggccttgtaaggctgtttccttttgcatctggaactgactatataattgtcttcaatgaagactaattcaattttgcatatagaggagccaaagagagatttcagctctgtatttgtggtatcagtttggaaaaaaaaatctgatactccatttgattattgtaaatatttgatcttgaatcacttgacagtgtttgtttgaattgtgtnngntttttcctttgatgggcttaaaagaaattatccaaagggnganagagcagtatgccact

SEQ ID NO: 8448 - DNA, 313 bp, Homo sapiens
ctggagactcaaactcctgtacagctaccttctgggaaatagtttttgacacctatttttcagattcttgtccggaatttctgctgctcttttcaaaaaagggcattaacaattctctggaaataaagcacctgttagcctgacatatgcaaaaagcagggcggcatcacccattacgagctcccccagccagcagtcagtattggattggccttgcctggctggtggcagtttgggagaaacagccaaagaggttagtttatttcaacaccaaattagaccatggcccatttccaacgggtctctttaaagg

SEQ ID NO: 8449 - DNA, 428 bp, Homo sapiens
  misc_feature (1)...(428): n = g, a, c or t
cctggctcancaaaagggctggggattggccctgaaaggagagagctgactgtcctggctgatggacaggagatcctcttagcactaccctaaggcaggcagtngggcattggtgtagacaacaggaaagtccaggctatagccgnactcaaaaacctttctgtnccctttctgccanccctagggattgagtccacattcagcacaggactctctgggtacagctntctttaggaagacacaaattgcatggtgaagtcagttatatcctggccgcctttggtccctcccaggaagacgggcatgttttctgcntgnnaggtgctgatgtnccagttggggaactgggcagactcaanttccggcttgttattgattnctatcttgntgaagacaaatcgcttttccatcttcttnctttgggtaat

SEQ ID NO: 8450 - DNA, 383 bp, Homo sapiens; identical to SEQ ID NO: 7947

SEQ ID NO: 8451 - DNA, 68 bp, Homo sapiens
  misc_feature (1)...(68): n = g, a, c or t
caagcttttttttttnntttttttttttttttttgctttnaatatattttattctgacnaagttacaa

SEQ ID NO: 8452 - DNA, 368 bp, Homo sapiens; identical to SEQ ID NO: 8376

SEQ ID NO: 8453 - DNA, 608 bp, Homo sapiens
  misc_feature (1)...(608): n = g, a, c or t
ccacactctacttctgcttctgccacctatggggtcgaggcaggtgtggtgccttggctaagtccacagacttctgagaggcccacgctttcttcttctccagaaataaaccctgaaactcaagcagctttaatcagagggcaggattccacgatagcagcatcagaacagcaagtggcagcgagaattcttgattccaatgatcaggcaacagtaaaccctgtggaatttaatactgaggttgcaacaccaccattttcccttctggagacttctaatgaaacagatttcctgattggcattaatgaagagtcagtggaaggcacggcaatctatttaccaggacctgatcgctgcaaaatgaacccgtgccttaacggaggcacctgttatcctactgaaacttcctacgtatgcacctgtgtgccaggatacagcggagaccagtgtgaacttggtaagatggtacttggctgaaaaggtgcagttctttcacagaagatatattgggggagaatntatgttgncgaatcaatcagagatttcaaagaaacccatatgaagattaattatatgttaaatgaagttaaaatctgagggtaattaac

SEQ ID NO: 8454 - DNA, 323 bp, Homo sapiens
  misc_feature (1)...(323): n = g, a, c or t
ctgtgttnccatgggacccctctnattcattagccttgggcttacactgagttctccacatgaaactgatgacttgtccanaacaactgcccagcaaaagctaagactcattcaacttgaaggcttgaaaacccaacaagtnaaccttttctaccttctttatgctctcttgcaagtccttatataggtttatattttcctggccccataggggcagaccttatagaggcaaagacctttgaattctggggagatggtgatcaccttattaactcccttctgcatacgtggattacagaggagtaagcanaccaagagcacag

SEQ ID NO: 8455 - DNA, 264 bp, Homo sapiens
  misc_feature (1)...(264): n = g, a, c or t
ccacaacaactgacgcggcctgcctgaagcccttgctgtagtggtggtcggagattcgtanctggatgccgncatccagagggcagaggtccaggtcctggaaggagcacttcatctgtttagggccatcagcttcaaagaacaagtcatcctcattgccactgtaataagccatcatttcactggcgagctcaggtacttntaccatggctgcttcagacacttgagcaatgaagattggctgaagagaatcccagagcagcc

SEQ ID NO: 8456 - DNA, 434 bp, Homo sapiens
  misc_feature (1)...(434): n = g, a, c or t
ctgcatccacagacttcaactacatgattacttctttgcccattcttctctttnttttctttcccgaataacctntttcagatacggtncanggtagaaattttnctcttnatatttggtccactgctctttangcaanatctgatgcttcaanattcaggtccagtgccctcttaatgcgaaacatcctgtcattatnaaggttctcaggaagtcttcttatggcttcttttacatcttcatcctcntatattgtatcatctcgcattaaccctatgatagatgacaaagttagattgcacatgcatctcaaaaatngcggnttttttaaattagtnaaatacctttatgacttataacttacaacttttggngaactatcgaattcaaatnactaggttcaatggaaattcaatgcatttcatacattatag

SEQ ID NO: 8457 - DNA, 490 bp, Homo sapiens
cctgagcagacactgctgggggagagagaaagttcacatccccccaccaagcacggtctcagattaggttattacaaagggcgagggggaggagggcatcccaggagtctaacatccaacccgacctatgtagaatgacgggtgaccacgccctgacccagccacacacttgaaccctgggacttcagtgaggtaggtggtatcagccccatttcacaggtgggcaaactgaggcagaatgaaatgcaatagctcgcttttaataacaacatacaaaagtctggagaaggccccaaagtagtcccctgttcccagagcccaaagaataaacagatgggagaacaagaccctcctcttccttttcccccacagagaagatccctaaacacatcaccggaacccctcaaatattcctgggaacttcaaacaaaaaaacatagcaacaaagagacccagcttccagtttattcccagttgggtaggggacagg

SEQ ID NO: 8458 - DNA, 338 bp, Homo sapiens
  misc_feature (1)...(338): n = g, a, c or t
ctgcccgcaggccccaggtcttcatggagttgctccttanttctctatgaaacacctcctctgctgagaagtccccgtggtgcaggagcagtaaggtatccccagacttgntggagaatgggactagctggtcaccccgctgccgggcnatcacagtgaccacgtgagctgggcccaggtcagggtcatnnncgctcagnccnncataggaaaagganacncgcaagtctnccacctntggatacttgggattttngntgtggtagaaaaagtctccacggcgaatgatgtccacatgagggtcctccagcttggataggctcanggacttgaagttg

SEQ ID NO: 8459 - DNA, 477 bp, Homo sapiens
  misc_feature (1)...(477): n = g, a, c or t
ccagtggaatgatgttccctgcaattaccatctcacctatacgtgcaagaaaggaacagtcgcttgcggccagccccctgttgtagaaaatgccaagacctttggaaagatgaaacctcgttatgaaatcaactccctgattagataccactgcaaagatggtttcattcaacgtcaccttccaactatccggtgcttaggaaatggaanatgggctatacctaaaattacctgcatgaaccgtaagtggtcctttanaaagaatggactaccgtgctataacaactactagacaccttcattttacggctgtngtatcggcagtttanggtatggagcaagtaatattgngtgttttctttttttctttctttccttccatgtagcatctgcntaccaaaggacttattctatgaaatactttaaaaattnctcatcaacaaaggacaattcaataaatacatccnaacatgatca

SEQ ID NO: 8460 - DNA, 429 bp, Homo sapiens
  misc_feature (1)...(429): n = g, a, c or t
ccaaaaaaaagaaggccntnntgacctgccacataatncnttggggaaagaaatctaatattcatagcacanaagaactcaaagaggataaaattctggaagccatggaatggtactcagaagtgcctgcggngaaacactccatatgcttttctcaaacacatntgttaaaaacaaatgtagttctnaaaaatattgagatgccatgttttaaatctctgcangacacaagaggccactcaggttttctaatnttatttgaacacaaaatatttaattttttgcatgtagagaataagaggtaatcattancctgaaaagagaggatttataatcancattatgcagaaagaaagcaaaattacaaataccanncctactcacatgaaaatttttcangtttacgctgatatatatctgagtgcttat

SEQ ID NO: 8461 - DNA, 423 bp, Homo sapiens
  misc_feature (1)...(423): n = g, a, c or t
gcacgccctgcaagggaggtatccgttacagcactgatgtgagtgtagatgaagtaaaagctttggcttctctgatgacatacaagtgtgcagtggttgatgtgccgtttgggggtgctaaagctggtgttaagatcaatcccaagaactatactgataatgaattggaaaagatcacaaggaggttcaccatggagctagcaaaaaagggctttattggtcctggcattgatgtgcctgctccagacatgagcacaggtgagcgggagatgtcctggatcgctgatacctatgccagcaccatagggcactatgatattaatgcacacgcctgtgttactggtaaacccatcagccaagggggaatccatggacgcatctctgctactggccgnggtgtcttccatgggatngaaaatttca

SEQ ID NO: 8462 - DNA, 154 bp, Homo sapiens
  misc_feature (1)...(154): n = g, a, c or t
agcagcagcttaaatatgaggcaagcagtcaggggttagccatgcctggggctgggttggggtcatgaggctacaggcacagactgtccccaggtggacagaagttggagcaggaagaggaggaggaaggggccgcanagcancctgggtcaga

SEQ ID NO: 8463 - DNA, 251 bp, Homo sapiens
ccagtcccagcagtctgactttttttttctttaagagacagggtctcactctgttgctcaggctggagtgtagtggcgcgatcatagctcgctgcagcctcaaactcctgggctccagtgatcctcccctcagcctcctgagtacaggtgcacgtcactgcagccagccagtctgacatcttgattccagggtggaaaacccttcttgtctccatggtaatggctgggctctcccaccctccaatagttca

SEQ ID NO: 8464 - DNA, 379 bp, Homo sapiens
ctgaaaaaaatcatgcagacatttgttacacagcagtggaaacagagcaaagaaaaatccaattgcctgcacaataaaaagttgtcagagaagaaagtgaagtctcccctgcatttattttctactttgcgcaggtcgccaagttatcctccccctggttgtggcaaaagcaaatccaaactgaaatctgagcaggacggaatctccaaaacgcataagctgctgcggaggacttgttccagcacagtcaagactgatgatgtgtgtgtcacaaagtcacacaggacctttggccgctccttgtccagcgatcccagggcggagcaggctatgacagcaattaaatcgcacaaacttttgaaccgtccttgccctgcag

SEQ ID NO: 8465 - DNA, 514 bp, Homo sapiens
cctttgagagatatgggcatagaattcaccctcaaaaagctcatgttctgattaaccacatcaacagttaagtaatatggaagtcaagtaacaaagacaataacacaactaattataaacaagacatataagcagtttaataccaccttagtgattctgattgactcatattgataacatattccacatggtcatgcacaataactccatttaccctaaatcatggattagtttccatcaaaacaccactccatttgagttttaaaattaaaagtattctccagcacaattacaggattttgaaaaccagaacacagtatagaaacataaaatatatataaaattaaccaaaattaaaataagacaatgtattaatagataatcatactataaacacacaatcactggctgaactagacaaggaaagggtaaattctttgagggcagggccttttccttgtcctgcagctaggaacaaagcacccagaacaacagatgtcatgggcttgataaa

SEQ ID NO: 8466 - DNA, 408 bp, Homo sapiens
  misc_feature (1)...(408): n = g, a, c or t
ctgggagatgctggatacntattatttggagtggtgttatttgtttgggaactcttacctaccaccttagtcgtttatttcttccgagttagaaatcctacaaaggaccttaccaaccctggaatggtccccagccatggattcagtcccagatcttatttctttgacaaccctcgaagatatgacagtgatgatgaccttgcctggaacattgcccctcanggacttcagggaggttttgctccanattactatgattggggacaacaaactaacagcttcctggcacaagcaggaactttgcaagactcaactttggatcctgacaaaccaagccttgggtagcatcagttaacagttttatggacgattcctcanatgaaaagcttcagaaaagcatagtgacag

SEQ ID NO: 8467 - DNA, 136 bp, Homo sapiens
gcagtgaagcctctggacacacagagatcccccagcccagtgctctgccaggaatagacgtcggctcatctgtaatgtccccacaggattcttttaaggaaattcatgtaaatattgaagcgactttcaaaccatc

SEQ ID NO: 8468 - DNA, 470 bp, Homo sapiens
  misc_feature (1)...(470): n = g, a, c or t
ccagttcttagctgtggatcccaaagggcgagccgttatgattagtgccattgagaaacagaaattggtgtatattttgaacagagatgctgcancccgacttaccatttcatctcccctggaagcccacaaagcaaacactttagtgtatcatgtagttggagtagatgtcggatttgaaaatccaatgtttgcttgtctggaaatggattatgaggaagcagacaatgatccaacaggggaagcagcagctaatacccagcagacacttactttctatgagctagaccttggtttaaatcatgtggtccgaaaatacagtgaacctttggaggaacacggnaacttccttattacagttcctggagggtcagatggtccaagtggagtactgatctgctctgaaaactatattacttacaanaactttggtgaccagccagatatccgctgtccaattcccagnangc

SEQ ID NO: 8469 - DNA, 492 bp, Homo sapiens
  misc_feature (1)...(492): n = g, a, c or t
ctgtctgtnctanacaaggttaccaagtgcggaattggttaatactaacagagagatttgctccattctctttggaataacaggacatgctgtatagatacaggcagtaggtttgctctgtacccatgtgtacagcctacccatgcagggactgggattcgaggacttccaggcgcatagggtagaaccaaatgatagggtaggagcatgtgttctttagggccttgtaaggctgtttccttttgcatctggaactgactatataattgtcttcaatgaagactaattcaattttgcatatagaggagccaaagagagatttcagctctgtatttgtggtatcagtttggaaaaaaaaatctgatactccatttgattattgtaaatatttgatcttgaatcacttgacagtgtttgtttgaattgtgtttgttttttcctttgatgggcttaaaaganattatccaaagggagaaagagcagtatgccact

SEQ ID NO: 8470 - DNA, 429 bp, Homo sapiens
  misc_feature (1)...(429): n = g, a, c or t
ccaaattccagcatgcctggttcaagagaagttcagatacacccggactcggatcaaatctcagggcttcatgggaattcatttcactctgaagatgaaattgaatatgaaaaccaaaaaaggctggaagaagaggaggacttgaatgtgcttacatttgaagatcttctttgctttgcatatcaagttgccaaaggaatggaatttctggaatttaagtcgtgtgttcacagagacctggccgncaggaacgtgcttgtcacccacgggaaagtggtgaanatatgtnactttggattggctcgatatatcatgagtgattccaactatgttgtcaggggcaatgcccgtctgcctgtaaaatggatggnccccgaaagcctgtttgaaggcatctacaccattaagagtgatgnctggncatatgga

SEQ ID NO: 8471 - DNA, 512 bp, Homo sapiens
  misc_feature (1)...(512): n = g, a, c or t
cctgagatgaaatttaaagaatatgtagaatctaggtaagtggataaaaggtctgggggcaggggaaaggagagcatttcattgtgaatcaaggaatttctccacctgttttaactcttccatatgacatcaaagagatgtcacttgcagctagcatttcagtgatgttttcttactaataatatcgtgataaaagaaacattgactataagaaataggaatgggtctcataaaaggaaacagcaaaacccccaaactaaaaaacaacgcaggctatttctctcttctctccttttgcttggcactcatgagatgctaggtgtggaagtcagccaactgaaaaagagaggtggctgaagaaggtggggaggctgaagccagttaaataggatggtccaattcacagacggcgaggctacagtgcaaataggactctttcaacttgancangaccccattacttcactggagttagaaagaaaggagagcgtagactttttgaactttctata

SEQ ID NO: 8472 - DNA, 301 bp, Homo sapiens
  misc_feature (1)...(301): n = g, a, c or t
cctgattatctaaaagctatttggaatgtaatcaactgggagaatgtaactgaaagatacatggcttgcaaaaagtaaaccacgatcgttatgctgagtatgttaagctctttatgactgtttttgtagtggtatagagtactgcagaatacagtaagctgctctattgtagcatttcttgatgttgcttantcacttatttcataaacaacttaatgttctgaataatttcttactaaacatttngttattgggcaagtgattgaaaatagtaaatgctttgtgtgattgaatctgattg

SEQ ID NO: 8473 - DNA, 449 bp, Homo sapiens
cctggctcaacaaaagggctggggattggccctgaaaggagagagctgactgtcctggctgatggacaggagatcctcttagcactaccctaaggcaggcagttgggcattggtgtagacaacaggaaagtccaggctatagccgtactcaaaaacctttctgttccctttctgccagccctagggattgagtccacattcagcacaggactctctgggtacagctctctttaggaagacacaaattgcatggtgaagtcagttatatcctggccgcctttggtccctcccaggaagacgggcatgttttctgcttgagaggtgctgatgtaccagttggggaactgggcagactcaaattccagcttgttattgatttctatcttgttgaagacaaatcgcttttccatcttcttctttgggtaatttttgggatctacactctccag

SEQ ID NO: 8474 - DNA, 428 bp, Homo sapiens
  misc_feature (1)...(428): n = g, a, c or t
tttttttttcaattaagctatttttatttaacatgtaatagtcataaagcanctccatatatttagttttctgatatcctaatgtatttccacaaaccttttaagtctacaattttatatagttttccatcagggaggcaagatatatataatttctttttatatttaactaaaggttttaagagggcttantctctaaatcagtancaattagtcntaacaccatacaaacacatttaaatattcaggaaagaggttgttaanattattgcttantcttataaaatggtgaattttaaccaaattgatacctctgtaatcttatttatgtttcctataacatcatactgcttggcaagtaatgtaagttttgacataatttaaaaattcaagtanttgtaaacaaattctaatttgttaaacaattc

SEQ ID NO: 8475 - DNA, 364 bp, Homo sapiens; identical to SEQ ID NO: 8232

SEQ ID NO: 8476 - DNA, 240 bp, Homo sapiens
  misc_feature (1)...(240): n = g, a, c or t
ctgctgttacnttcanagaataagagcaaccataactnacatcaagccaatttanattagactaatntaanttgtctaattaaattgnctctagatgagagcccaatctcatctagaantgaagaaatctntctattgacagntattagtnnaagaggttctaatacccngtgtaaggcagaaatatacattggagttagtctgtctgangtatgcagaacaaatggcantatcatgaag

SEQ ID NO: 8477 - DNA, 441 bp, Homo sapiens
  misc_feature (1)...(441): n = g, a, c or t
ctgccgctgctcgttgttttttctgcaatgatatttgggactattacaaatcaagatctgcctgtgatcaagtgtgttttaatcaatcataagaacaatgattcatcagtggggaagtcatcatcatatcccatggtatcagaatccccggaagacctngggtgtgcgttgagaccccagagctcagggacagngtacgaagctgccgctgtggaagtggatgtatctgcttccatcacactgcaagtgctggtcgatgccccagggaacatttcctgtctctgggtctttaagcacagctccctgaattgccagccacattttgatttacaaaacagaggagttgtttccatggncattttgaaaatggnagaaacccaagctggagaatacctactttttattcagagtgaagctaccaattacacaatattgtttaca

SEQ ID NO: 8478 - DNA, 515 bp, Homo sapiens
ccagatgacctgttgtctaccaaagaaagctgggtagaagcaactcctagacaagttgtagagctctcagggagttcttcgattccaattacagaaggctctggagaagcagaagaagatgaagatacaatgttcaccatggtaactgatttatcacagagaaatactactgatacactcattactttagacactagcaggataatcacagaaagcttttttgaggttcctgcaaccaccatttatccagtttctgaacaaccttctgcaaaagtggtgcctaccaagtttgtaagtgaaacagacacttctgagtggatttccagtaccactgttgaggaaaagaaaaggaaggaggaggagggaactacaggacctgatcgctgcaaaatgaacccgtgccttaacggaggcacctgttatcctactgaaacttcctacgtatgcacctgtgtgccaggatacagcggagaccagtgtgaacttgattttgatgaatgtcactctaatccctg

SEQ ID NO: 8479 - DNA, 189 bp, Homo sapiens
  misc_feature (1)...(189): n = g, a, c or t
cctgggtgatacatggcgnaagagaanattccaganacttatgccaggatcccaccataaaagagctggaatcgattataagcaaaaggaatattcaattttcctgcaagaatatctncagacctgacaagtttcttcagngtgtgaaaaatcctgaggattcatnntngcacatctgagatctgagcc

SEQ ID NO: 8480 - DNA, 272 bp, Homo sapiens
  misc_feature (1)...(272): n = g, a, c or t
agggcccaaggcagccccctgggttctccaaccactgcaagcaaggtctggggacaaccttgacaacccccagccttcttgctgggctggcgctgctgccactcaaataggacataggacaagcttgtctgacatcagctactggagttaaattatggctttataggactcaaacctgttgtttttcccaactctgttctctccctccaatncaacccctgccacagtgcatgggcaggctagccttgaatggactggacagacaccaacag

SEQ ID NO: 8481 - DNA, 349 bp, Homo sapiens
  misc_feature (1)...(349): n = g, a, c or t
ccaggctcccaggtgacttacgttaatagcanacttctagttagaagaggagaatttatttcattaaaaaaaaaaaataagtcaaacagttcaagaaagtattcatttatgtaaaagaagtcaattggtatgttactaaagataataggaagaaaattagctcactattttagttgcntactgatgattttaaggtttaaataattaagatttaaatataccgtatgtaaatgtagaagtctgtatcgtaataaatctgttgctaagnaaaatgggaatncatgacaacgaggaatgtaggtattaaaaatgtcagaattagaangagaacagnaaaagagcaaaagct

SEQ ID NO: 8482 - DNA, 412 bp, Homo sapiens
  misc_feature (1)...(412): n = g, a, c or t
tgtacatgggggtaggccggggcacaaagcctgttcctaagactaacttgggaccaaggagccctgaggagttggggcacgggctccacagaaacatctaggcttcggtaaccaatgcacagtgacgctcccatgttgacttaaaaagcagataaaaacaaccaaacaaaaagtccctaccattgcacccctgtagtaggccgttgtgatcgtccgaaaccgttcctgaccggctgtgtccctaaacatgaagagaagggatattagcaacattaaaggaaaataactgtcctcagtaggagacaaggagcatctacccgggatgcctggctttctcaccgttcagccactgngataccttcttctgctaangcagcaccttctaatctccctattattacanggaaggaca

SEQ ID NO: 8483 - DNA, 445 bp, Homo sapiens
ctgaggaagctcttcattggagggttgagctttgaaacaactgatgagagcctgaggagccattttgagcaatggggaacgctcacggactgtgtggtaatgagagatccaaacaccaagcgctccaggggctttgggtttgtcacatatgccactgtggaggaggtggatgcagctatgaatgcaaggccacacaaggtggatggaagagttgtggaaccaaagagagctgtctccagagaagattctcaaagaccaggtgcccacttaactgtgaaaaagatatttgttggtggcattaaagaagacactgaagaacatcacctaagagattattttgaacagtatggaaaaattgaagtgattgaaatcatgactgaccgaggcagtggcaagaaaaggggctttgcctttgtaacctttgacgaccatgactccgtggata

SEQ ID NO: 8484 - DNA, 357 bp, Homo sapiens
ccaaaggcttccctcacgtgcaggtagggaatggtgtggtccaggaccgcttgcatgagccaggaatcttgcagtcttcaaagattagctcacaggtgttagagcccctcatccccagcttgtccagcttcttagaggtgctaaagccaggcatacccttctccacaatgaaggctgtgatgccccgagaagctggcacagcagccagatctgtcttggcatagacaatcaggacgtcagcatcagggccattagtgatccagaacttgttgccattcaggatgtagtgatttcctttcttttccgctttgagcttcatagagacaacatcagagcctgcattgggctcactcatgg

SEQ ID NO: 8485 - DNA, 494 bp, Homo sapiens
ccagaatagaagtgtcttatctaacctgaccagctcaaggtaaaagacctcaagaatcggacattggctgtgtctgtgtctccaaagaaaatgtcccagtcagctcaccctactgtgaaacccatattgaatccagaacttctatttagtttgtgtcctttttttctcataaacaaatttgttatagtcttactaagatataattggcatagaataaactttacacttaaagtgaaaaacttgagttctgaggcatgtatatatttccacagtcgccaccacagtcaggtaatcattcccctaaattttttgtgcctccttatcttccttcccttcccctaccccagctcctcctttcctcaggcagccccgatctgctttctgtcgctatagaataatttgacttttctggaattttatgtacatggaatcatacagtatgtgttcttttttggtctgacattcactcaccataattgagtttcatccatgtt

SEQ ID NO: 8486 - DNA, 505 bp, Homo sapiens
  misc_feature (1)...(505): n = g, a, c or t
ccaactaatttagttttgatgcactgtcagatagactaatcactgtctaagattttcctgaatctctgcttcatgttatgcttttcaaggagatgataatagcttgttaaccaccattcacagctcttcaactactcacaagccttcaagaactcaccttaaggagcccactgaatattaaatattaaacagctacaaaagagtgctactaagacaattttgctttgatgagctggataaaatcaagtcagaggttcagtataaactctgacaggactttaataattcctaatatgtatgaaatgaaaatgaaaatggtcaaaatcatttaggaactctcaatttttcaagactcgaagcaaattaaccatggactttatacttgtaattagttaagaagaaaagctattgcctaaaagcagttatgtgtgngtaattcttgacttcggatatctaatttcttctattccaaggtatttagttctaaggtaactaaaatagtaac

SEQ ID NO: 8487 - DNA, 469 bp, Homo sapiens
  misc_feature (1)...(469): n = g, a, c or t
ctgtctcttacttttaaccagtgaaattgacctgcccgtgaagaggcgggcataacacagcaagacgagaagaccctatggagctttaatttattaatgcaaacagtacctaacaaacccacaggtcctaaactaccaaacctgcattaaaaatttcggttggggcgacctcggagcanaacccaacctccgagcagtacatgctaagacttcaccagtcaaagcgaactactatactcaattgatccaataacttgaccaacggaacaagttaccctagggataacagcgcaatcctattctagagtccatatcaacaatanggtttacgacctcgatgttggatcaggacatcccaatggtgcagccgctattaaaggttcgtttgttcaacgattaaantnctacgtgatctgagttcagaccggagtaatccaggtcggnttctatctacttcaaattcctccct

SEQ ID NO: 8488 - DNA, 380 bp, Homo sapiens
  misc_feature (1)...(380): n = g, a, c or t
ctgatgatggacagtgaaactggtcgatccaagggatatggatttattacattttctgactcagaatgtgccaaaaaggctttggaacaacttaatggatttgaactagcaggaagaccaatgaaagttggtcatgttactgaacgtactgatgcttcgagtgctagttcatttttggacagtgatgaactggaaaggactggaattgatttgggaacaactggtcgtcttcagttaatggcaagacttgcagagggtacaggtttgcagattccgccagcagcacagcaagctctacagatgagtggctctttggcatttggtgctgtggcagatttgcaaacaanactttcccagcagactgaagcttcagctttagc

SEQ ID NO: 8489 - DNA, 544 bp, Homo sapiens
  misc_feature (1)...(544): n = g, a, c or t
ccatcggtgctgaaattgancattttaaatagtacagtaggctggtatacattaggaaatggactgcactggaggcaaatagaaaactaaagaaattagataggctggaaatgcttactttctgctctcattttctttcattttgtctgctgtctttttgaatgccaatactttcatttaaaatgttttgggagcacggcaacccaaaatgactgaacggtggtccaaaaatccaaaccaactgataattacttctcaaggtgataggaaaggcacaggaagttaggactttggctgaaatgatgaaaacacatgttcgccattttagggatcagcgcctngactcctgccacctncggctccaacgatgatcatgtttggatgtatttattgaattgtcctttgctgatgaggaatttttaaagtatttcatagaataagncctttggtatgcanatgggttcatgcaggtaattttaggtatagcccatcttgcatttcctaagcnccggatagttggaaggtgacgnngaatgaaaccatc

SEQ ID NO: 8490 - DNA, 597 bp, Homo sapiens
  misc_feature (1)...(597): n = g, a, c or t
ccatataatttttagctacaaaagtttaagcaaaaacaaactctgcaatgatgtggaatagcagaaaagatcctttgcaggcaagagactctagcatatttacctatgtagttaacaggctgcagacctggttgctacatacctgtattgtgtatttcctcagcaatatacatgccttctcgataggttagtcccccgacaacaggagttcctgtggctggagccagtgtagggtcaaatgcatcaatatcaaaactcaaatggattggtctttgtctcctaaaaaggaagaggataaaataatacttaaaataatacttaactggttgtccttggacactcatccttcttatggttgcaactccttgattttgttgctattagtcctagtactttgttaataaagctgttaatacatttccaggcttcctattcttggaagttactgagattggcaatattaacttcctacataccacttcatgatactgccatttgttctgcatacctcagacagactaactccaatgtatatttctgccttacactgggtattagaacctcttatactaataactgncaatagagagatttctt

SEQ ID NO: 8491 - DNA, 173 bp, Homo sapiens
  misc_feature (1)...(173): n = g, a, c or t
aagaagatggaanagcgatttntnttnaacaaganagaaatcaataacaagctggaatttgagtctgcccagttccccaactngtacatcagcacctctcaancanaanacatgcccgtcttcctgggagggaccaaaggcggncaggatataacngacttcaccatgcaatt

SEQ ID NO: 8492 - DNA, 312 bp, Homo sapiens
  misc_feature (1)...(312): n = g, a, c or t
acaagctnttttttttnnttttttttttttttngctttgaaatgatttattcacctgggaaagtgatcacaacttgctgntaattaaaaccaacantanaacagngagtncaattgaagtccatcattgttattatcataaatatgcncccaacaaaaaacaaactaaaanaaaatncnctcaaaagcacacagngggcacattttgtntttgggtagnggaagtgtaggtaatgtcagtgttnggggtttttntttgaatttttaagctgttttaaaaataagttttgttattaggaaaattntttttaaa

SEQ ID NO: 8493 - DNA, 343 bp, Homo sapiens
  misc_feature (1)...(343): n = g, a, c or t
ccagcaatnnaaggaggctcgaaagtttcttttataagaatgcctgctagcaagggttccagcaaggtggttggttggtctgtaagtcagtcttgagtacttgaaacagttctgtgtttgttttttttccttancgtttagaatagccatcattgtccggcaataggcagagctatcacgtccaggaaaaatgagggagggaaccacagaggcagcgtgagatccaaatacagcattcaaaggtaattggtccagtggtgcctggggagggaggaagggtgatactccagggttagccgtcttnttttgggggtgtgtaccanccgnttntttcgnggatctg

SEQ ID NO: 8494 - DNA, 550 bp, Homo sapiens
  misc_feature (1)...(550): n = g, a, c or t
ccacgagannattgtgaacctgctgggggcgtgcacactgtcaggaccaatttacttgatttttgaatactgttgctatggtgatcttctcaactatctaagaagtaaaagagaaaaatttcacaggacttggacagagattttcaaggaacacaatttcagtttttaccccactttccaatcacatccaaattccagcatgcctggttcaagagaagttcagatacacccggactcggatcaaatctcagggcttcatgggaattcatttcactctgaagatgaaattgaatatgaaaaccaaaaaaggctggaagaagaggaggacttgaatgtgcttacatttgaagatcttctttgctttgcatatcaagttgccaaaggaatggaatntctggaatntaagtngtgtgntcacagagnnctggccgccaggaacgtgcttgtcacccacgggaaagtggtgaagatatgtgactttggattggctcgagatatcatgagtgattccaactatgttgtcaggggcaatgcccntctgcctgtaaaa

SEQ ID NO: 8495 - DNA, 574 bp, Homo sapiens
ccttatgaaggacattgtaggagccaatgagaaagaaatagccctaatgaatgctttgactgtaaatttacatcttctaatgttatcattttttaagcctacgccaaaacgatataaaattcttctagaagccaaagccttcccttctgatcattatgctattgagtcacaactacaacttcacggacttaacattgaagaaagtatgcggatgataaagccaagagagggggaagaaaccttaagaatagaggatatccttgaagtaattgagaaggaaggagactcaattgcagtgatcctgttcagtggggtgcatttttacactggacagcactttaatattcctgccatcacaaaagctggacaagcgaagggttgttatgttggctttgatctagcacatgcagttggaaatgttgaactctacttacatgactggggagttgattttgcctgctggtgttcctacaagtatttaaatgcaggagcaggaggaattgctggtgccttcattcatgaaaagcatgcccatacgattaaacctgcattagtgggatggtttggacctgcc

SEQ ID NO: 8496 - DNA, 366 bp, Homo sapiens
  misc_feature (1)...(366): n = g, a, c or t
ctgttcttagaaagcatnccatatanttatccagagcactcangttttggttctcttttacatanctgcattcggagatactctatgtgagacatgtttaaaaaaagagaaacatttatacctggaatttatattcttncaagtaatnttttantcttgttggtaaaggcagtccccanatggcaccggtacattngttaatggngagcctacagagatgctgcnganatggtgctgacgtgtanagcggtttggncanataaaggtgnacagtgccgttncggggggcttctggacctgtccgcttatccttgcncatntgaacatagtngtcgatcagatganccanactgtcaaattgtttaa

SEQ ID NO: 8497 - DNA, 504 bp, Homo sapiens
cgaggtccttcttcactgaagagtatgtcagggaccaccctgaggaccaggacaagctgacccacctcaaggacctgattgcatggcagatccccttcttgggagctgggattaagatccatgagaaaagggtgtcagataacttgcgacccttccatgaccggatggaggaatgtttcaagaacctgaaaatgaaggtggagaaggagtacggtgtccgagagatgcctgactttgacgacaggagagtgggccgtcccaggtctatgctgcgctcatacagacagatgtccatcatctctctggcttccatgaattctgactgcagcacccccagcaagcctacctcagagagctttgacctggaattagcatcacccaagacgccgagagtggagcaggaggaaccgatctccccggggagcaccctgcctgaggtcaagctgcggaggtccaagaagaggacaaagagaagcagcgtagtttttgcggatgagaaagcag

SEQ ID NO: 8498 - DNA, 455 bp, Homo sapiens
  misc_feature (1)...(455): n = g, a, c or t
ccaccaccagctttggctctaactgcagactttgttcttggtgaattgctatagaactgggaatgaggtgtgccctgggcacaggggcactgccccaccaaggtggtgcccactccactgctgggaaaacgaagttacctagcggagcctggagcccactgggtggtcactaatttcagcacaggcagtgcagtgtttgtgctttttttttggagatggagtctcactctgtcacccaggctggagtgcaatggcgtgatctaggctcactgcaacctccgcctcccaggttcgagcaatcctcctgcctcagcctcccaagtagctgggactacaggcacacgccgncacgcctggctagtgtttgctcttaaatacacaaaatgcactgaaccagcaaaaacaaagtcccaggtctgaggagctctgaggatgatgcctgtgatggcctctgg

SEQ ID NO: 8499 - DNA, 544 bp, Homo sapiens
ggacgggcccggtgcggctgtgtgggttcgggagcggagttgcagaatccaaggacccgttttgttctttctccgcactgctttatgggaggcattatggcccccaaagacataatgacaaatactcatgctaaatccatcctcaattcaatgaactccctcaggaagagcaataccctctgtgatgtgacattgagagtagagcagaaagacttccctgcccatcggattgtgctggctgcctgtagtgattacttctgtgccatgttcactagtgagctctcagagaaggggaaaccttatgttgacatccaaggtttgactgcctctaccatggaaattttattggactttgtgtacacagaaacggtacatgtgacagtggagaatgtacaagaactgcttcctgcagcctgtctgcttcagttgaaaggtgtgaaacaagcctgctgtgagttcttagaaagtcagttggacccttctaattgcctgggtattagggattttgctgaaacccacaattgtgttgacctgatgcaaacag

SEQ ID NO: 8500 - DNA, 289 bp, Homo sapiens
  misc_feature (1)...(289): n = g, a, c or t
aatcaacntatagtttanttttttctgggtttttgttttgttttgttttctttctaatcgaggtgtgaaaaagttctaggttcagttgaagttctgatgaagaaacacaattgagattttttcagtgataaaatctgcatatttgtatttcaacaatgtagctaaaacttgatgtaaattcctcctttttttccttttttggcttaatgaatatcatttattcagtatgaaatctttatactatatgttccacgtgttaagaataaatgtacattaaatcttggtaaaa

SEQ ID NO: 8501 - DNA, 303 bp, Homo sapiens
ccgggcaggtcaagagtgagccattctccatccctgaggacgacggcaatgacctcactcacaccttcttcaatccagaccgggagggttggctgctcaagctagggggccgcgtgaagacgtggaaacggcgctggttcatcctgaccgacaactgcctctactacttcgagttcaccactgacaaggagccacggggaattatacctcttgagaacctctcggtgcagaaggtggatgaccccaagaagccattctgcctggagctctacaaccctagctgccgaggccagaaaatcaagg

SEQ ID NO: 8502 - DNA, 341 bp, Homo sapiens
ctgcccaagggcgttcgtaacgggaatgccgaagcgtgggaaaaagggagcggtggcggaagacggggatgagctcaggacagagccagaggccaagaagagtaagacggccgcaaagaaaaatgacaaagaggcagcaggagagggcccagccctgtatgaggaccccccagatcagaaaacctcacccagtggcaaacctgccacactcaagatctgctcttggaatgtggatgggcttcgagcctggattaagaagaaaggattagattgggtaaaggaagaagccccagatatactgtgccttcaagagaccaaatgttcagagaacaaactaccag

SEQ ID NO: 8503 - DNA, 514 bp, Homo sapiens
  misc_feature (1)...(514): n = g, a, c or t
gaaatcgaantgttgaatttttggcttgtgagagtttggttccaaaccttaaattcantcaaggtctgtgtctttgttagttacaaaactttaactttattcaaattgatgagctcttgaataattgataatatagnataaatgaaaattaaattctactaaaatctattgaagcangaaaaaaagagcgctatggaccttgactancagagtaatttcccctgttctgttgttcactttctcataaatgttcattagtaggtaaaaattgcaggggatgatataaactgatgcatctgttttgcaataacatatctaatcttctgctccaggagacgttcacagaatttgncagcnaaacctaatacatattcataaccaatatgctntntnaccaanggaaattgaggcaagtacaacagaatgaancatgagaaaccagcatgttaattttaaatttaattatagttataggggaaaaggctgcattntgatagtgtatactcattcagac

SEQ ID NO: 8504 - DNA, 610 bp, Homo sapiens
ctgtcaccaccaagcatgaactttcactgattacccataacctactggaaatcttcagccttgctgtcagcatagaccactgtgagaaacagtacattccattccagtttgccctgctttttgaagatctaaatgccattccatgttttctgttacatattgaagtttcttggttgccaaagaaaaacggattctgctgaacttgtggacagaacaaccccaaggttggaagaaaaaggaaaaataatctatacttgaacatttcaaaagttaaaattttcaacagagttttaacacactgaagcttaaaatacattgacactgaaatgtcaatgggcaaacaccaatttcgccgttcattatgaaatacatcaaacaaaacttgccaaaaatacaaccataaaaatatagcaaatgtatgtatgagcaaactaatgctaaaaatgtctaattttcttggctagtctttcaaggaccagattcatgagtgttatttgaagggaaaaagtgaaatacttggaattattttgagtgatgtgctcctgagcttgttcttaaaatctaccagtggtagcttttggaaagaatgtgtttcataccgatgtgcagg

SEQ ID NO: 8505 - DNA, 285 bp, Homo sapiens
ccacagtgtcaacctgagtggagaaccacgagttctcaccccggtagttgggagtaaggtccagaatgacacggatgctcttttttttagccgattgcaagagactgtcaaaatcttccttggagccaaaattggggtcgatctgcagcaagtcagtctgagcgacatcatccttctggttcttgtgaattggacccagcacaaggcccttcaccttcagagagctcaggtaatcgagacgccccttcagacccgccaggttgcccgcgccgtggccctggaagg

SEQ ID NO: 8506 - DNA, 242 bp, Homo sapiens
  misc_feature (1)...(242): n = g, a, c or t
actgacgancnggtcacataatcaggagccagactnctgagttgtaactgggcccccaactttccgtgtgattattaaaagagcccttcttcttttctaaaacttantgccaaatgctgaggagcataatgtnggtgagaattttttttttttgggggggngaaaattaagctagagcttnttgaantacctagttnccaggggctttttattgtatttttncttatggncctagantgaca

SEQ ID NO: 8507 - DNA, 554 bp, Homo sapiens
  misc_feature (1)...(554): n = g, a, c or t
tttttttttatcgttaacaaaagaaaaaaatgtctttataagtacataccttttgtcgtcaaaaaaaatatagaaacacaatgtattcaaaaaaaatcaaaattatacagccatgtttatgaagtctacatttcccttgtcttggatatatatatatggagatatatatacaattcaagcagttttaattaagggtaatcattgggtttttctgaaaccggaaaagtcacgagtctctctcttttttcactttcacatctccagcaaggatggttgcaatttccccttgcataaaggcccaggggacattggagcccacaagagggcatttttccccactgggacaatagacctctccactagctccctgctgtttgatgctttgtctggagcaagggaagcagaacttgtgcgaagggacggacgggcactgcacaaaatgggtgtcctccagccgctcgtggcagagggtgcagcacagcggggcactggttgccaganaggagtccgggaggctggcagggtgcactggctccagtcctcctgtgttgcct

SEQ ID NO: 8508 - DNA, 449 bp, Homo sapiens
ctggagagtgtagatcccaaaaattacccaaagaagaagatggaaaagcgatttgtcttcaacaagatagaaatcaataacaagctggaatttgagtctgcccagttccctaactggtacatcagcacctctcaagcagaaaacatgcccgtcttcctgggagggaccaaaggcggccaggatataactgacttcaccatgcaatttgtgtcttcctaaagagagctgtacccagagagtcctgtgctgaatgtggactcaatccctagggctggcagaaagggaacagaaaggtttttgagtacggctatagcctggactttcctgttgtctacaccaatgcccaactgcctgccttagggtagtgctaagaggatctcctgtccatcagccaggacagtcagctctctcctttcagggccaatccccagcccttttgttgagccagg

SEQ ID NO: 8509 - DNA, 391 bp, Homo sapiens
cctaagacccaacagatgtaggatccagatctggattcgtgccagccccaccaatggtctgtcaggccaagaaggtgctttctttggtaattcatgttttttaacttcctggagaagagatcttttcccacaagccatcttcattttttttgtagagtagggctttatttccaggaaacagtgtgttagctggagatgggtgtttttttaaaaacatcaaggtagatctaatatgttcaacaaagtggggtggctcagccagaggcgaagtggaaagattctctagtatttgcttgtcatcttggtgcaaccagaaatccacatgtggaaatggtgtccaggagtacggtcctatacgaagttgttctgtctctgcatcataaatgctaat

SEQ ID NO: 8510 - DNA, 335 bp, Homo sapiens
  misc_feature (1)...(335): n = g, a, c or t
ctgtggcngnctgtcanagaagcacatttttctgcagataattagaatggcttcccccatctctcacggactgtcccaagtctagaaaagaattgagttcctcttctattagtcaaataaaagggaagagaatgtttgtcttcctttcctttctgtagtgttaagaaaataaacgaacttaatgattctaaattatcagtgagcttaacactgtactatagaccaaagattaccttttcaaaaagtcctttgaggtgaaatattttgtatacgtaatacatagatgcacatataaacacacacatatagaatctcaatattttaacacttctttg

SEQ ID NO: 8511 - DNA, 604 bp, Homo sapiens
ccactcattctactgcttagctcacagtgtttctgcagcggtatgtctcaccacttgttctgttgttccccttacacactccagtatgtatctctgccatcaaactgtccacgtgtgagctgaacctgctatttgttcattaacttactgttttataccatttgagcaggaagttgtagtcattctctggctttgtagtttgctttattgctcataagtaataactggaaaaaggagttttaaaacactcattattttcaaacattttgactaatatttattctgaaatgtcagggtaatttggtaaaatatcaaaatgctaaaactgaagacttatttttttctttaccagaaagtaataattacatatatttataactgcagagtccaatacaatgaattaatatttcttccaaatgttcttacttaacatctttctagctttagcaaagcagtatcttactttcacattaaaaaaaagaaacccttcataatagtgtaaggcagtttgtggaaaacttattaccgtcattttacactttactaaattcaggctaaaccatcatcaaattaaccagaattaagattagggctcaagtcttct

SEQ ID NO: 8512 - DNA, 529 bp, Homo sapiens
  misc_feature (1)...(529): n = g, a, c or t
gnaaatattccaaaattaactgtggtgacagatgcacttacctgtgactacactaaaagccactgaattgtacacataaaatgggtgaattttaagatatgtgaattatatctcaataatgttatttttaataatgctgttattaagattttgattgggattaaattgggatctatagatttggagaaaacatgtatgtttataatattgattctttcaatncatgaacattatataatgctccaattatttgggncttctttagtttctctcaataatgtnntatagaattccatgcagaagtactgtacatattttattanagtcattcctcgatatttactattactgatgctatttatatggtntattttaaagaagacaaagcattgaatttttttattgtggggaagaacagagcatggtgtncatattaaataatcaaaatttcaaaataaatcactatacatggnctaacatgattntttctgattttaaattttatttacagaaaagtcatacaaatata

SEQ ID NO: 8513 - DNA, 592 bp, Homo sapiens
  misc_feature (1)...(592): n = g, a, c or t
caaagatattccagccagggtaaccctgatgcagctccctaccaggcaagagatccgagtgaggaacctgttcaatgtggtggactgcaagctccattggcagaagaacggagactacttgtgtgtgaaagtagataggactccgaaaggcacccagggtgttgtcacaaattttgaaattttccgaatgagggagaaacaggtacctgtggatgtggtcgagatgaaagaaaccatcatagcctttgcctgggaaccaaatggaagtaagtttgctgtgctgcacggagaggctccgcggatatctgtgtctttctaccacgtcaaaaacaacgggaagattgaactcatcaagatgttcgacaagcagcaggcgaacaccatcttctggagcccccaaggacagttcgtggtgttggcgggcctgaggagtatgaacggtgccttagcgtttgtggacacttcggactgcacggtcatgaacatcgcagagcactacatggcttccgacgtcgaatgggatcctactgggcgctacgtcgtcacctctgtgtcctggtggagccataaggnggacaacgcgacctcggcc

SEQ ID NO: 8514 - DNA, 591 bp, Homo sapiens
tgatcagcccctaaaggtaatgccagcccctccaccaaaggagaatgcttgggtgaagcgaagttctaaccctcctgctcgatctcagagctcagacacagagcagcagtcccctacaagtggtgggggaaaagtagctccagctcaaccatctgaggaaggaccaggaaggaaagatgaaaataaagtagatgggatgaatgccccaaaaggccaaactgggaactctagccgtggtccaggagacggagggaacagagaccactggaaggagtcagataggaaagatggcaaaaaggatcaagactccagatctgcacctgagccaaagaaacctgaggaaaatccagcttctaagttcagttctgcaagcaagtatgctgctctctctgttgatggtgaagatgaaaatgagggagaagattatgccgaatagacctctacatcctgtgcttttctcctagtttctctccaccctggaacattcgagagcaaatcaaaacctctatccagacaagacaaaataaaactcaacatctcctgaagacctttcttacctttttttaaaaacaaaaaatgaaattattttgc

SEQ ID NO: 8515 - DNA, 476 bp, Homo sapiens
  misc_feature (1)...(476): n = g, a, c or t
tgctgcctcacatcancatgttgtcaggatcttgcatcantattgagcaccanccattccctgaccagactctatgtgggggagaatgccttgggagactcaggagtngcaattttatgtgaaaaagccaanaatccanngtgtnacctgcagaaactggggttggtgaattctggccttacgtnagtctgttgttcagctttgtnctcggtactcagcactaatcagaatctcacgcacctttacctgcgaggcaacactctcngagacaaggggatcaaactactctgtgagggactcttgcaccccgactgcaagcttcaggtgttggaattagacaactgcaaccttacgtcacactgctgctgggatctttccacacttctgacctccanccanagcctgcgaaagctgagcctgngcaacaatgacctgggcgacctggggtcatgatgttctgngaagtgctgaaacag

SEQ ID NO: 8516 - DNA, 616 bp, Homo sapiens
  misc_feature (1)...(616): n = g, a, c or t
ctcaaatgcngtcggcttgtcctggctcttgccctcatcctggttctggaatcctcagttcaaggttatcctacgcagagagccaggtaccaatgggtgcgctgcaatccagacagtaattctgcaaactgccttgaagaaaaaggaccaatgttcgaactacttccaggtgaatccaacaagatcccccgtctgaggactgacctttttccaaagacgagaatccaggacttgaatcgtatcttcccactttctgaggactactctggatcaggcttcggctccggctccggctctggatcaggatctgggagtggcttcctaacggaaatggaacaggattaccaactagtagacgaaagtgatgctttccatgacaaccttaggtctcttgacaggaatctgccctcagacagccaggacttgggtcaacatggattagaagaggattttatgttataaaagaggattttcccaccttgacaccaggcaatgtagttagcatattttatgtaccatggttatatgattaatcttgggacaaagaattttatagaaatttttaaacatctgaaaaagaagcttaagttttatcatccttttttttctcatgaat

SEQ ID NO: 8517 - DNA, 294 bp, Homo sapiens
  misc_feature (1)...(294): n = g, a, c or t
acgtgaaaatgctacagttatggataanacccnagctttgattgantccgttattccgaaaggggcacaggcatgccaaatttgcatcacatacatttgtgaagaagacagntacctggcagagacgctgggactctnancagctcttcaggcagtgcaggacaacccagctatgcccacatgctcaagcccanaaggcanaatcaagctttgctttctagaanacgctcaanggatatggaaacaaaagttgcagaggtgccatgttcagaatacaataataaagtggagcga

SEQ ID NO: 8518 - DNA, 580 bp, Homo sapiens
  misc_feature (1)...(580): n = g, a, c or t
ctggtttnnanttctaanngtataaaaattggaaatttgaaatagttctgtaaaagaaaaaaatgtaaaaatacatctgctttctctcatggtttaatacagcattggaaggctttcanatgttttcttaaaaaaaaacaaaacccaaaaaaactcaacatttaaaaccaaatctcagcttcatttccagaaatattgcagtttggtttaggtaatgtttcatttaatctactccagtttccacaaaatggcattttattaaaaaaacctttcagttatttggtccttttgcaatttgctgtgcacataatgcctactgtaccaaacttttattgcctttaaatttagttgtaattttattgataaaatttaaatctagtgtctttatttcttctgttacaatagtgttgcttgtgtaagcaggttagagtgcacagtgtccccaattgttcctggcactgcaaaaccaaattaaacaattccacaaagaattctgacatcaatgtgttttcctcagtcaggtctatttcaagattctagaagttccttttgtaaaacttgcctttaaaactcttcctcc

SEQ ID NO: 8519 - DNA, 332 bp, Homo sapiens
ctgccacaaaccaggtgaagctttgttctaagaatatttgtttcatctagtttatgagtccaaatgatatagactgtaaatgtcacagcagtggtgaaagactgctcggtcatgagcaccgacagtaactcactggcacgtgaatttctgaccgatgtcaaccggctttgcaatgcagtggtccagagggtggaggccagggaggaagaagaggaggagacgcacatggcaacccttggacagtaccttgtccatggtcgaggatttctattacttaccaagctaaattctataattgatcagtagagatggggtttcaccgtgttgaccag

SEQ ID NO: 8520 - DNA, 587 bp, Homo sapiens
  misc_feature (1)...(587): n = g, a, c or t
cctaaggctgatgaggaagaggaagtgtcagatgaagtcgatggggcagaggtccctaaccccgactcagtcacagatgacctcaaggtcagtgaaaagtcagaagcagcagtgaagctgaggaacacagaagcatcttcagaagaagagtcatctgctagcaggatgcaggtggagcagaatttatcagatcatatcaaactctcaggtgagaagatggttgattaggtttcacatataagtagtaggtggttgatgatcagatgtcttaaatggatgttcactatgacaagtatctgactagtccacatagcttaatcagtaatctaccaaagtcatgggtaactcaaccaatagtcccagggaatattgtaaaagtcaggagcctcactgctatgtgtagcagaattgtgagacaagcagccagcagtgcctatttggtttaataaaaaagaagattctaaaatgagtttttttttttcgtgcaactcaatttacaatatacgtttttggaaggcttcttttgaattcacatgagtagagaaaaccaattatagataattctttgtagatncttagctttcgac

SEQ ID NO: 8521 - DNA, 647 bp, Homo sapiens
  misc_feature (1)...(647): n = g, a, c or t
ccatcatctccaactctttaccccaacctggcaccttgtagggggctagaagggtgaggggaggtgtctttcacttatgcttaggtcactcttagaggactatcctcaaacttgaggtgacagggaactcttcacgggggcaggatttgatgttttgtttttagccatgtttgtcaatgacaatgtcaatttctagttccaatttgtacccttgtctcatttctacattaaaaacaaaaaacaatcatctgtcataaaagttcagagtaagctgggtgtggtggcacatgactttagtcccagctacttggggggctgaggcaggagggtcgcttgagcccaggaaagttcgagtccaagctgggcaacagagcaaaaccttgtctcttaaaaaagaaaaaaaatagagttcagaatagataaaagagttgttattctaagaaaatagactactgaaggagaaaggctttaataatattaaaaataggcaaggtaatgcttttcatagtatagtaagatttgcctaataccatcttatttctttgattaaaagttacttancttcagcatgcgtgtacattcaaaatacaaaattaaagcatgagttgtcattaatttgcagaattctatgattgaagcctctaaat

SEQ ID NO: 8522 - DNA, 474 bp, Homo sapiens
ccatataatacttgcacattatgcaaaaaaaaatgttgatagtatctccttgccacacaatatgcagagttgacaacctttgaaaaccaaggtaactaatatgtttgtcctagttgtgtggcgcttggtaacaaagtctgtacatattatgtataaaatgtgtattggttagcatttagtactaagaaattctgagtttaaaataagtgatttttttcaaagtagcgatatctatatctgtgtttatctaaaaatactggcttgaatagaaaacattctcagatgattcaagattgagtaaaaatgagaatcccatacattccattattaaattctgccctattcccaattgttagcatctggctgatattaaggtctttgattgtcacaatattctcaataaatgagacattctgaactgcctggtgatattttcaaaaagagcaattaaaatgtgtattccctctaatacag

SEQ ID NO: 8523 - DNA, 568 bp, Homo sapiens
  misc_feature (1)...(568): n = g, a, c or t
agctagacnaagttggtcatgatgcagaagctactcaaatgcagtcggcttgtcctggctcttgccctcatcctggttctggaatcctcagttcaaggttatcctacgcagagagccaggtaccaatgggtgcgctgcaatccagacagtaattctgcaaactgccttgaagaaaaaggaccaatgttcgaactacttccaggtgaatccaacaagatcccccgtctgaggactgacctttttccaaagacgagaatccaggacttgaatcgtatcttcccactttctgaggactactctggatcaggcttcggctccggctccggctctggatcaggatctgggagtggcttcctaacggaaatggaacaggattaccaactagtagacgaaagtgatgctttccatgacaaccttaggtctcttgacaggaatctgccctcagacagccaggacttgggtcaacatggattagaagaggattttatgttataaaagaggattttcccaccttgacaccaggcaatgtagttagcatattttatgtaccatggttatatgattaatc

SEQ ID NO: 8524 - DNA, 591 bp, Homo sapiens
  misc_feature (1)...(591): n = g, a, c or t
gttcaatnaagacagngtggctaggaaatccctggaaggactcccaccactaagacttgtcaaaaattcttcaaacagtacttgcagaggccctgaaatttctgggacttctataaaatccctccctgggcttgaaaaaataattttgaatttgggcagtctagagccttagagagctaagagctgatagtagctctatcagagtaaactcaaaaacaaacacacggggggtctctagggctctctggctggtggcttcatgggtacataagcctgtctttccaccaaggaatctggcttgggatgcttattcatatttgaatcacgaaagcccaccatttaaataatatttggtaaagatcttttaggttaattagatcttacatatacttttgcaaaagctacctctggatcatttctagtattactagcatttcagatattgnttataactatcacccttgtagatattacactaaattaaaacaatagtgatacaaattcccaccttaccaaaatagcaataatccaatttatttcctagtttatttaatcagattctcctaccaaccatctcctcttctatttttt

SEQ ID NO: 8525 - DNA, 581 bp, Homo sapiens
  misc_feature (1)...(581): n = g, a, c or t
cctgaatttnaaccttcactggaggttttactatgatcctnctgagttccagaccattattattggagataataaaactcagtaccacatggggtatttcagggattctcctgatgaatttcctgtatatgttggtataaatgaagcaaagaaaaattgtataattgttccaaatggagataatgtatttgctgcagtcaaattatttttgacgaaaaaacttaaagaaataacggataaaaagaaaatcaatctcttgaaaaacatanatgaaaaactcacagaagcagccagagaattggggtactcgcttgaacagagaaccgtgaagatgaaacagagagataagaaagttgtgacaaagacctttcatggtgcaggcttggttgttccagtagataaaaatgatgttgggtaccgagagctccctgaaacagatgctgacctcaagagaatttgcaagacaatagttgaggctgcaagtgatgangagagactaaaagcttttgctcccattcaggaaatgatgacttttgtgcagtttgctaatgatgaatgtgattatggcatggggcttgaat

SEQ ID NO: 8526 - DNA, 549 bp, Homo sapiens
  misc_feature (1)...(549): n = g, a, c or t
ctagactnanttggtcatgatgcagaagctactcaaatgcagtcggcttgtcctggctcttgccctcatcctggttctggaatcctcagttcaaggttatcctacgcagagagccaggtaccaatgggtgcgctgcaatccagacagtaattctgcaaactgccttgaagaaaaaggaccaatgttcgaactacttccaggtgaatccaacaagatcccccgtctgaggactgacctttttccaaagacgagaatccaggacttgaatcgtatcttcccactttctgaggactactctggatcaggcttcggctccggctccggctctggatcaggatctgggagtggcttcctaacggaaatggaacaggattaccaactagtagacgaaagtgatgctttccatgacaaccttaggtctcttgacaggaatctgccctcagacagccaggacttgggtcaacatggattagaagaggatnttatgttataaaagaggattttcccaccttgacaccaggcaatgtagttagcatattttatgtacca

SEQ ID NO: 8527 - DNA, 542 bp, Homo sapiens
ccactgcactgaaaaaattgaaaagtcttggtttaattcatgctgatctcaagccagagaatattatgttggtggatcctgttcggcagccttacagggttaaagtaatagactttgggtcggccagtcatgtatcaaagactgtttgttcaacatatctacaatctcggtactacagagctccagagattatattggggttgccattttgtgaagccatagacatgtggtcattgggatgtgtgattgcagaattatttcttggatggccgctctacccaggagccttggagtatgatcagattcgatacatttctcagactcaaggtttgccaggagaacagttgttaaatgtgggtactaaatccacaagatttttttgcaaagaaacagatatgtctcattctggttggagattaaagacattggaagagcatgaggcagagacaggaatgaagtctaaagaagccagaaaatacattttcaacagtctggatgatgtagcgcatgtgaacacagtgatggatttggaaggaagtgat

SEQ ID NO: 8528 - DNA, 505 bp, Homo sapiens
  misc_feature (1)...(505): n = g, a, c or t
ttctaatngtataaaaatnggaaatttgaaatagntctgtaaaagaaaaaaatgtaaaaatacatcngctttctctcatggtttaatacagcattggaaggctttcagatgttttcttaaaaaaaaacaaaacccaaaaaaactcaacatttaaaaccaaatctcagcttcatttccanaaatattgcagtttggtttaggtaatgtttcatttaatctactccagttnccacaaaatggcattttattaaaaaaacctttcagttatttggtccttttgcaatttgctgtgcacataatgcctactgtaccaaacttttattgcctttaaatttagntgtaattttattgataaaatttaaatctagtgtctttatttnttctgttacaatagtgntgcttgngtaagcaggttanagtgcacagtgtccccaattgntcctggcactgcaaaaccaaattaaacaattccacaaagaattctgacatcaatgtgtntttcctc

SEQ ID NO: 8529 - DNA, 402 bp, Homo sapiens
  misc_feature (1)...(402): n = g, a, c or t
tacttctagagttatatagtcccagagatgtttatgactatttacgtcccattgctctgaatctgtgtgcagacaaagtttcttctgttcgttggatttcctacaagttggtcagcgagatggtgaagaagctgnacgcggnaacaccaccaacgttcggagtggacctcatcaatgagcttgtggagaactttggcngatgtcccaagtggtctggtcggcaagcctttgtctttgtctgccagactgtcattgaggatgactgccttcccatggaccagtttgctgtgcatctcatgccgcatctgctaaccttagcaaatgacagggttcctaacgtgcgagtgctgnttgcaaagacattaagacaaactctactanaaaaagactgtttcttggcct

SEQ ID NO: 8530 - DNA, 591 bp, Homo sapiens
ccaaaaaaatcaagatttaatttttttatttgtactgaaaaactaatcataactgttaattctcagccatctttgaagcttgaaagaagagtctttggtattttgtaaacgttagcagactttcctgccagtgtcagaaaatcctatttatgaatcctgtcggtattccttggtatctgaaaaaaataccaaatagtaccatacatgagttatttctaagtttgaaaagtaaaaagaaattgcatcacactaattacaaaatacaagttctggaaaaaatatttttcttcattttaaaacttttttaactaataatggctttgaaagaagaggcttaatttgggggtggtaactaaaatcaaaagaaatgattgacttgagggtctctgtttggtaagaatacatcattagcttaaataagcagcagaaggttagttttaattatgtagcttctgttaatattaagtgttttttgtctgttttacctcaatttgaacagataagtttgcctgcatgctggacatgcctcagaaccatgaatagcccgtactagatcttgggaacatggatcttagagtcactttggaataa

SEQ ID NO: 8531 - DNA, 555 bp, Homo sapiens
  misc_feature (1)...(555): n = g, a, c or t
gctcacctgcnccaccccaggagaaactgcagacctatcagccagaggntgttaaggcaaatcaagcggaaagtatgtcttcttaagctaccatttacatgttttcatatttgcatttatcatttgcttctaattatctgtctagaccatagtaagaattaacttgttttgtttgttttagggtaatcttacatgagccttctttagaaacagcaatcgattcttttttattttttaatgatacagaaaattgtttatattaattttgtttgcttacttctgcatttatattttgttccactagtcctcanacttcttcagtgaataattttttttttctccaaaattaagataagttctttgtttggagctatgtaccacatcctttcaggtgttcttctgaattatatttaatctttgataatgagtgaaaagcncagacattcctggagtaagacatctatgtgttctctcctagatgatcctaccagacaatatgaangaccattacatnactatcgaccacagcaggaatcaccatctccccaacaacag

SEQ ID NO: 8532 - DNA, 595 bp, Homo sapiens; identical to SEQ ID NO: 8184

SEQ ID NO: 8533 - DNA, 591 bp, Homo sapiens
  misc_feature (1)...(591): n = g, a, c or t
ctgacacaggcaaacagnngcacaagtggaatagaatacaatgcctgattctcacttgttgtctccaaccaagccaacatggagcacatgatgaagtcccactcactctctgccaaaggggatgagcagtatttcagaaatagggaaagaaaccggattatttctatatttacacccagtacctctggacttgcttctgatagattacaactgaaaagaaaaatatcttcatgctctttcttccaggatattatgatttttaatattccatgtaatagctctccatcatctatacttttggtttgcagacaagaattgaaaatggcaagatgtccaaaacctccattagtgctgcaaagatctttcttagtccagcccaaaagagcaggtatacattgagcactaaattctttcttttcttcttttgacaaaaatggacatagactttgaatggtatgcaaattgccttcagttagtggaaaaaaactttcttttctcttataatgtggttttacttcatcagatgaaatgcttcgggaaaggatcaacttancaataataagagaccacagtgtgccatgttctctggac

SEQ ID NO: 8534 - DNA, 485 bp, Homo sapiens
  misc_feature (1)...(485): n = g, a, c or t
ggaatccncanttcaaggttatcctacgcagagagccaggtaccaatgggtgcgctgcaatccanacagtaattctgcaaactgccttgaagaaaaaggaccaatgttcgaactacttccaggtgaatccaacaagatcccccgtctgaggactgacctttttccaaagacgagaatccaggacttgaatcgtatcttcccactttctgaggactactctggatcaggcttcggctccggctccggctctggatcaggatctgggagtggcttcctaacggaaatggaacaggattaccaactagtanacgaaagtgatgctttccatgacaaccttaggtctcttgacaggaatctgccctcagacagccaggacttgggtcaacatggattagaagaggattttatgttataaaagaggattttcccaccttgacaccaggcaatgtagttagcatatttnatgtaccatggntatatgatta

SEQ ID NO: 8535 - DNA, 361 bp, Homo sapiens
cctgtggaaaagggaagtggacaacatttatattacaagacagtaattttattgaaacatctttttttgtctaaaactatgcatggagatattaatctcttgtttataaattaggttaagtctaacatcactatttgaaaccagtgttatttacaaaaatgaacctcttctttgctttattgttggtttacaggaataattttaaaccaacctcaatctatctttaaaaatcttcctgccttcaaatgcccagcaacccttataaggtagggggcagccctttgacagcaacattcatcattcaccaggaatgtagaaccacaagtgaacaacaacaacaacaacaacaagattaaatcat

SEQ ID NO: 8536 - DNA, 582 bp, Homo sapiens
ctgttggtcagtatgccaataacatcacactttggatctttgcagtcactgcaggcatgttcctctatgtagccttggtggatatgcttccagaaatgttgcatggtgatggtgacaatgaagaacatggcttttgtcctgtggggcaattcatccttcagaatttaggattgctctttggatttgccattatgctggtgattgccctctatgaagataaaattgtgtttgacatccagttttgacctttcccagtaatcactgttgattacgagaatgttaccatgcagctttgcatctgttccttgtactgtatgcacattgctcaaaggaaagtcagtggcttgcactacttacaagtttcatagatttgagcctaaccacaagaggctggtgcttagtactgttttccctgcacgtaggggtcttttaaaaatataaagcttgtgataaagagaggagaatatgggactccatgaaccagtgttgatatgtttgattaagacttttcacaaaataatcatataaaacactagtctctttattagtagaaacttctgtggctatgcagaaatagagatc

SEQ ID NO: 8537 - DNA, 310 bp, Homo sapiens
  misc_feature (1)...(310): n = g, a, c or t
caagctttnnttttttttttttttttttttttttaggagccaaaatagttatttattaataatttaaggttttacattcttataataaatttcagctctaaactttacaccacgaacataatggagaatttaactntcccttcttcacaatcaaatgcatttctcttatcaaatgggtacccatgctcacacacacacacttccagttttatacaaatttttttaaaggaaagaaaccaacccaaagtattgcatttgaggngacactccctgaaaaattttatncagaggtaatatactgtttagcaca

SEQ ID NO: 8538 - DNA, 602 bp, Homo sapiens
  misc_feature (1)...(602): n = g, a, c or t
cctcttgaaacctaggcttggaactggcatacagtcacttcttccacattctattgatcaaatcaagtcacagtgccagcccagattcaaatggtggggaaagagacttcatttatggaagggaggagctgcaaatttcattgccaagaggtgtggatacccagaaagatacatttgacaaaccatctatcaaagttactgtcagaggtatgtttttggaaatatcatttggagtgggatgtgtcctgtatgactggaatcgttttctatttgtaacagagaagcgtgcccactccttgcacccatagataacccaatgccgaaggatatgagagagagagatgtccagtttgtgcctctcccagcttcttgtccagagactccttggtttagattttgatacactacttagaaaaggtggagagtttctttaagatttcatccacagagggccgcacagagggatcatgggcccggcactcatcaatgatctcccgcagctctgaagggcagtcttcacccagtggctcctgctgccgnttcacagccaccagcttgcggatcttctcagaattacagccttgaaacgggatatctccagt

SEQ ID NO: 8539 - DNA, 575 bp, Homo sapiens
  misc_feature (1)...(575): n = g, a, c or t
ctggtgggagggatgaaggaaattatctggacgatgctctcgtgagacaggatgcccaggacctgtatgaggctggagagaagaaatgggggacagatgaggtgaaatttctaactgttctctgttcccggaaccgaaatcacctgttgcatgtgtttgatgaatacaaaaggatatcacagaaggatattgaacagagtattaaatctgaaacatctggtagctttgaagatgctctgctggctatagtaaagtgcatgaggaacaaatctgcatattttgctgaaaagctctataaatcgatgaagggcttgggcaccgatgataacaccctcatcagagtgatggtttctcgagcagaaattgacatgttggatatccgggcacacttcaagagactctatggaaagtctctgtactcgttcatcaagggtgacacatctggagactacaggaaagtactgcttgttctctgtggaggagatgattaaaataaaaatcccagaaggacaggaggattctcaacactttgaatttttttaacttcatttttctacactgntattatcattatc

SEQ ID NO: 8540 - DNA, 468 bp, Homo sapiens
ccttgttccactgtgccttggtttctcctttatttctaagtggaaaaagtattagccaccatcttacctcacagtgatgttgtgaggacatgtggaagcactttaagttttttcatcataacataaattattttcaagtgtaacttattaacctatttattatttatgtatttatttaagcatcaaatatttgtgcaagaatttggaaaaatagaagatgaatcattgattgaatagttataaagatgttatagtaaatttattttattttagatattaaatgatgttttattagataaatttcaatcagggtttttagattaaacaaacaaacaattgggtacccagttaaattttcatttcagataaacaacaaataattttttagtataagtacattattgtttatctgaaattttaattgaactaacaatcctagtttgatactcccagtcttgtcattgccag

SEQ ID NO: 8541 - DNA, 638 bp, Homo sapiens
  misc_feature (1)...(638): n = g, a, c or t
ccaacatggngaaaccccatgtttactaaaaatacaaaaattagccaggcatggtggtgcatgcctgtaatcccagctactggggatctgaggcaggaggatcgcttgaacccaggaggcagaggttgcagtgagctgagatcatgccactgaactccagcctgggcaacagagagactccgtctcaaaaaaaaaaaaaaaaaaattcatcaaggtatatacatatacattcagattagtgtacatgtaaaatatgatatacaacagagcctttcatgaataggataatttgcatattcatatggaaaacatatgcagtatcttaagccatagttttccaaaatttcaaattaaatacttatagctttgacatattcctgttacttcaactttccagggatgctctagaagaaacgggagacatgttgtaagactttaatgacattccacaaactaaatttattgtgggaattaacatcagaaattaagggaaaaaatactctaatttgatcactanctgctacaagactccctanaaagtggaccatgtntatttttttcacaattctgtttgctaagtggaaaagctgcttcttggnagactcaaacatgacacatactgaaatggcaagcaatga

SEQ ID NO: 8542 - DNA, 533 bp, Homo sapiens
  misc_feature (1)...(533): n = g, a, c or t
cctgaaaagtggttctggaaaagtgtaccaaggccctgcaaaaggtgctgctgatacaacaatcatactttcagatgaagatttcatggaggtggtcctgggcaagcttgaccctcagaaggcattctttagtggcaggctgaaggccagagggaacatcatgctgagccagaaacttcagatgattcttaaagactacgccaagctctgaagggcacactacactattaataaaaatggaatcattaaatactctcttcacccaaatatgcttgattattctgcaaaagtgattagaactaagatgcaggggaaattgcttaacattttcagatatcagataactgcagattttcattttctactaatttttcatgtatcattatttttacaaggaactatatataagctagcacataattatccttctgttcttagatctgtatcttcataataaaaaaattttgcccaagtcctgtttccttanaatttgngatagcattgataagttgaaaggaaaannaaatcaataa

SEQ ID NO: 8543 - DNA, 591 bp, Homo sapiens
  misc_feature (1)...(591): n = g, a, c or t
ctcctatgnnataagaggaaagtttatcctctatactattcagatgtaaggaatgatatattgcttaattttaaacaatcaagactttactggtgaggttaagttaaattattactgatacatttttccaggtaaccaggaaagagctagtatgaggaaatgaagtaatagatgtgagatccagaccgaaagtcacttaattcagcttgcgaatgtgctttctaaattataaagcacttgtaaatgaaaaatttgatgctttctgtatgaataaaactttctgtaagctaggtattgtctctacaaaattctcattgtatagttaaaccacagtgagaagggttctataagtagttatacaaaccaagggtttaaatacctgttaaatagatcaattttgattgcctactatgtgaactcactgttaaaggcactgaaaatttatcatatttcatttagccacagccaaaaataaggcaatacctatgttagcattttgtgaactctaaggcaccatataaatgtaactgttgattttctcacttggtgctgggtactaggttnataaaattgtatgatagttattatatt

SEQ ID NO: 8544 - DNA, 518 bp, Homo sapiens
ccagctgtgaaactgatgaaaaagtttcttccgaataatctacattaacttgagagatattgaggtatgtttcttgattatcttctcccacaaatggcgatgtgtgagttaacaacatatatgctattataccaatattccacatatctgttgctgtggtaatgggatcatagttcaggatttctggagctaaatattctggtgttcccataatttcccgaagttcacacgcatgccctatttttcgagacattccaaaatctactattttaatgtccccgagagggtatatgctgctcagtaatatattctgtggctttaaatcaaggtgtacaatgttattctgatgtagataataaactccttcaagtatttgtttaatgagtctgataacatcattttcagaaaccatttcagccaactcaggtaaacacaggctgaaaatttctccacctgcagcactaaaataaaattcaaagaacagagacttgaaaattcattcacttaaacacttttaa

SEQ ID NO: 8545 - DNA, 597 bp, Homo sapiens
ctgactatatctcagggtagcttccttgtttctactcagaagctagttgggccacaactgtcacgacattctgcagagattcccaacctgggattccagaagatctctggacaggtcccttcagtaggcaagcgtctgagtagacagcaggctgatgaagagctgctaataattggtgggcttgctgtgccagtacacttgcggagtacctgttggtttgtcctgctgatgccccccaaccatgctaaataggtctgaggcacacattacatttggttgaatgagcccgttaatatcctaccacagatgaatacaatgaggtgacaggaaaacctaggaaccatgacttatgaagactggctgttaaagtagcatttatgaaaatggggtaagcacaaggctgataaaactaaaggatctggaagctcatggctagacttagtctgcagagaaaacccacccagttctacacaaagccatctccccacttttcaaaaataggtttttcacactagaattctggaaatgacttcatttggctttcctggcctgtatggatatgggtttacataacattggttacaatatatttattcc

SEQ ID NO: 8546 - DNA, 583 bp, Homo sapiens
  misc_feature (1)...(583): n = g, a, c or t
ctgggcgcatgaaagcagagttctttgcagatgtagttccagcagtcagaaagtggagagaggccggaatgaaggtgtacatctattcctcagggagtgtggaggcacagaaactgttattcgggcattctacggagggagatattcttgagcttgttgatggtcactttgataccaagattggacacaaagtagagagtgaaagttaccgaaagattgcagacagcattgggtgctcaaccaacaacattttgtttctgacagatgttactcgagaggccagtgctgctgaggaagcagatgtgcacgtagctgtggtggtgagaccaggcaacgcaggattaacagatgatgagaagacttactacagcctcatcacatccttcagtgaactatacccgccttcctcaacctagagaagggttgttaaggcagaccgccctgttccccananttgtccctgtagtgtctaggtttattctaatggtaaaagtaacttacttaaaaaacatatgtacacatatgtatgcaagtatgtatatatgtgtatgctcagattaacttccataggtacataagtgna

SEQ ID NO: 8547 - DNA, 612 bp, Homo sapiens
  misc_feature (1)...(612): n = g, a, c or t
catgtggagctgggacgtggagtgcgatacgtgcgccatctgcagggtccaggtgatggatgcctgtcttagatgtcaagctgaaaacaaacaagaggactgtgttgtggtctggggagaatgtaatcattccttccacaactgctgcatgtccctgtgggtgaaacagaacaatcgctgccctctctgccagcaggactgggtggtccaaagaatcggcaaatgagagtggttagaaggcttcttagcgcagttgttcagagccctggtggatcttgtaatccagtgccctacaaaggctagaacactacaggggatgaattcttcaaataggagccgatggatctgtggtcctttgggactcatcaaagccttggtttagcattttgtcagttttatcttcagaaattctctgcgattaagaagataatttattaaaggtggtccttcctacctctgtggtgtgtgtcgcgcacacagcttanaagtgctataaaaaaggaaagagctccaaattgaatcacctttataatttacccatttctatacaacaggcagtggaagcagtttcagagaactttttgcatgcttatggttgatcagttaaaaaag

SEQ ID NO: 8548 - DNA, 492 bp, Homo sapiens
cctcgtgaggcgaggcggcaaaatttgatttcttggaggacacctgagcatatacggtcaaagtctgatgacaacaccagtagggatgaagctgggagtggggtggctaagaacactggacctgacactattagacatgggttccagcttcaggtctattactgctcactgtggccgagcaacagagctacttaggtaaaatggtgatggtcataacactagcccacagggaggttacgaacctctggtgacaatgtaagtgaaaggcccctgagaaagagtgagggagttgcaaatgtcagtagccatcaagatcttctttaagaatagtttccactaaagagatgattgctttggtttccagccttctttgttttgtctccccgctgggccttctacctttaaagggctttggctctgggggaattgagttggctggggcttgatgacttccaagaggacacaagtggagatctactgcctgctcttggc

SEQ ID NO: 8549 - DNA, 524 bp, Homo sapiens
  misc_feature (1)...(524): n = g, a, c or t
cctatactcttaatgnactttattaaagtcccacatgagcaccgtgcaataattagagtttccccaataagtttacccaactatcaacctttattagtacttatggcttatggtgtggtttaatgtcttttttatttttcgaaaacaaatggcacttaagtgcacttcaaaaactgttaggtgatataagtaagctagaaaagtaagatcatcatgggctcttttctaacaaacgtgttgatgaaatgataagcaaaatgatgttacccctatgatatctagtaagacaccatggagcatcctagttttatccaagtactgcccaactaatgcaatttatgtcctgaatgtgcattagaatatcctgagtttcagtggcctgttaactggtaaacagtgccacagaaaacacaacactgggtagaggaaagtgggtagaggaaaatcccctgagcttaaatgatcttagatgaggtcttgttttgattttctattttatatatatttcatgttaaaatatctgg

SEQ ID NO: 8550 - DNA, 646 bp, Homo sapiens
  misc_feature (1)...(646): n = g, a, c or t
cctcctcgaccaaggcagggaacttcaatctgtataagtatctgcagttgctggaataatttgaagaccccatggagctaaggagattaagtggaggattttcattgtttcagaggggcaaggggcaaatccattgctaattctttaatgatgaaaaatggtaagaagttgttaaactcctttggggattttaaaaagtgatacgtaaacagaagagagagagagagagagaaatcacagtagtgaggctaacaaaaataatgataaaaaggttagaagaacccaggatacttagtggatgcctagacaacataaaaatagatttatagaaggaagcaatggaatttgaatataaaagggtatcagaaagttaatgtgttgcatctgaaattcaaagtatttccttttggctacacaagaaagacttttaataaaaccctttgtatatatttctgaaaggtaaatattttatagggaaatggaggattggaagaaaatctgttccatcatgtctgggtattagaattttgcttaataacttgccaaaatattacgcttccaagggctatggcattatgtgtgtacccaattaaagcaatttttctttgctttgtctcctaacttaaattcaaatgacatatnaacc

SEQ ID NO: 8551 - DNA, 394 bp, Homo sapiens
  misc_feature (1)...(394): n = g, a, c or t
ctgaggtngncagtacaatgaaaccaaactggcgggatggaagcagattattctgccatttttccaggtctttgagttgcacgtcaaatctggggctgatcaccccacacttgtttagcctgcctgtgaggttcacaacaattttcccagctctgtggtcatcaatgatttcaaattcgccaatgtaaccatgcttcatcatcacagtgagaaaccggacgatgactttggagcacggcctaataagcacctggcgtttgcctctcttttcggcattgttgatactcttgagagcatctgccaggacattcatgcgcaccattgtggcttagattgcaggatggcgccgatggcagacggatgaaattggagctctcagagagtgctactcgcc

SEQ ID NO: 8552 - DNA, 507 bp, Homo sapiens
  misc_feature (1)...(507): n = g, a, c or t
ctggtatttngcctaagatctatttaagataaccttttcttatattttttacttaatattgggcataatcgtatcattcaagattaagtctgggttatttctttgataagaactgaatgtggccgggcgcagtggctcacgcctgtaatcccagcactttgggaggccgaggtgggtggatcacaaggtcaggagatcgagaccatcctggctaacacggtgaaaccctgtctctactaaaaatacaaaaattagccgggtgtggtggtgtgcacctatagtcccagaactcaggaggctgaggtgggaggatcacctgagcccaggaggtcaaagctgcagtaagctgtgattgcgccactgcactccagcctgggtaaagagtgaggccctatcttaaaaaaaaaaaagggtgggcgtgatggctcacacctgtaatcctagcactttgggaggccaaggtgggtggcttacttgaggtcaggagttcaagaccacccttggacc

SEQ ID NO: 8553 - DNA, 597 bp, Homo sapiens
  misc_feature (1)...(597): n = g, a, c or t
cctcataaaangcaaaacaaaaattaggtattttgtcctaaaacacctggtaggagtgtgtgatttttttgcattcctgacaaaggagagcacacccaggtttggaggtcctaggtcattagccctcgtctcccgttccctttgtgcacatcttccctctccccattcggtgtggtgcantgtgaaaagtccttgattgttcgggtgtgcaatgtctgagtgaacctgtataagtggaggcactttagggctgtaaaatgcatgattttgtaacccagattttgctgtatatttgtgatagcactttctacaatgtgaactttattaaatacaaaacttccaggctaaacatccaatattttctttaatgcttttatatttttttaaaatgttaaaacccctatagccaccttttgggaatgttttaaattctccagttttttgttatatagggatcaaccagctaagaaaagattttaatcaagttgaattgaggggattaatatgaaaacttatgacctnttcctttaggagggagttatctaaaagaaatgtctattaaggngatatatttaaaaatatttttgggtgttcctg

SEQ ID NO: 8554 - DNA, 170 bp, Homo sapiens
atgtagctgatatattactataacctcacttgcatttttaaattattttactggttctctctttttacttttatcttacctatgctgtatttgaagttagttttatatagacagaattttaaaaattatttatttatggggtacaaatgcaatttggacaatattgttgg

SEQ ID NO: 8555 - DNA, 337 bp, Homo sapiens
  misc_feature (1)...(337): n = g, a, c or t
accacatagatagcttgacaaggagtgctgtctgtccttaccacattttcagcactcagcacagtgccttgtgtataataggcactcaatttattataaatcttcagtatgtcctgagaacagctttagtcatggaatactgggagaaggaataactttcacaaaataaacttaaaacagcctgtaattattgaggttcatattcttctggtatatcattctgagaaattgtggctaatttanaacattgtttagaattgacaaaaggccctggcaattaaattgtcaaggcccaagggctaattttaattttctttttacttggagtcattcaaag

SEQ ID NO: 8556 - DNA, 285 bp, Homo sapiens
  misc_feature (1)...(285): n = g, a, c or t
cctatttganagaggaaatgtatgatgaagctattcaggattatgaaactgctcaggaacacaatgaaaatgatcagcagattcgagaaggtctagagaaagcacaaagattattgaaacagtcgcagaaacgagattattataaaatcttgggagtaaaaagaaatgccaaaaagcaagaaattattaaagcataccgaaaattagcactgcagtggcacccagataacttccagaatgaagaagaaaagaaaaaagctgagaaaaagttcattgatatagcag

SEQ ID NO: 8557 - DNA, 562 bp, Homo sapiens
  misc_feature (1)...(562): n = g, a, c or t
tgaataaactaggtattgatgcaacatatctcaanataataagagctatttttgacaaacccaccgncaatatcatactgaataggcaaaagctggaagcattccctttgaaaaccagcacaagacaaggatgctgtctctcaccactcctactaaacatagtataggaagttctggacagggcaatcaggcaagaaaaagaaataaagggtattcaaataggaagagagaagtcaaattgtctctgtttgcagatgacatgactgtatatttagaaaaccccatcatttcagcccaaaatctccttaagctgagaagcaacttcagcaaagtctcaggatacaaaataaatgtgcaaaaatcacaagcattcctatgcaccaataacagagagccaaatcatgagtgaactcccattcacaattgctactaagagagnaaaatacctaggaatacaacttacaagggatatgaaggacctcttgaagtanaactacaaacaactgctcaaggnanttaagagaggacacaaacaaatgaaaaagcattccatgctcatgga

SEQ ID NO: 8558 - DNA, 491 bp, Homo sapiens
ccaagaactcaaagaggcagcattggaaccatcgatggaaaaaatatttaaaattgatcagatgggaagatggtttgttgctggaggggctgctgttggtcttggagcattgtgctactatggcttgggactgtctaatgagattggagctattgaaaaggctgtaatttggcctcagtatgtcaaggatagaattcattccacctatatgtacttagcagggagtattggtttaacagctttgtctgccatagcaatcagcagaacgcctgttctcatgaacttcatgatgagaggctcttgggtgacaattggtgtgacctttgcagccatggttggagctggaatgctggtacgatcaataccatatgaccagagcccaggcccaaagcatcttgcttggttgctacattctggtgtgatgggtgcagtggtggctcctctgacaatattagggggtcctcttctcatcagagctgcatggtacacag

SEQ ID NO: 8559 - DNA, 177 bp, Homo sapiens
  misc_feature (1)...(177): n = g, a, c or t
gagtggcttnctaacggaaatggaacaggattaccaactantngacgaaagtgatgctttccatgacaaccttaggtctcttgacaggaatctgccctnagacagccnggacttnngtcaacatggattanannaggattttatgttataaaagaggatnttcccaccttgacacca

SEQ ID NO: 8560 - DNA, 512 bp, Homo sapiens
  misc_feature (1)...(512): n = g, a, c or t
ctggcctcattgagctgctttctaatattaacgtgtaatgatgaatccattttatcaggacagtaggctacaaattgctctttggaaaataagtcaaacttaattctcatgaaaacaacctatctctctctccatatatatacatacatacatacatacatacatacatacatacatataaacatattccaaagatcttaaggtctatgatcaggttttatcatcacaggaaatttggaaaaaagtaaaaccaacttcagactctttttaacttatggctgtgttatctaatggctctccttaactgtcattaagagataaaatagctccagtgttacagacatncccgggcggccgctcgactcttttttctctccttccgggggaccaaggtaccttctggggcatacaacatggcagcagggcctcgggaagaggggtaggaggaccgagcagcattctctgtagaggaagacaggaaaggagaccctcttggcacacatttatggagg

SEQ ID NO: 8561 - DNA, 516 bp, Homo sapiens
  misc_feature (1)...(516): n = g, a, c or t
tattctaaattttgtagctcctgaccttacatccttttcttccttatgtctttcagatccaggtgaacttgagagaattagagacagccactgggctccccccggggttgaaacgggtttcccagaccaggggttcagaggagactatttatccttcatgatctttggcgattctccactggagcggaagggctgtgtgtcaaaagaaggaagccaggctgtgaagggccgtgttgctttcagtgggtgggcagaggtttagaaaggtggttctgaaatggcacctggtactcttgtgggacctggggaatataaggaactctgtgcatgaggtttcaaaaataaaaattgagtccactctccccgtacacacacactcgggcacttcangaggtcagttctcaccccttcctcgatggggctttaaagctctggggagaagagctgctccccactcatgccccagagggactgtgaaaaggcttcctgtgacctccgatggcggcccctcattgg

SEQ ID NO: 8562 - DNA, 481 bp, Homo sapiens
  misc_feature (1)...(481): n = g, a, c or t
ctattttcanngttctcacaacaaaaagataaatatgtgacataagagatgtgttaagcagcttgatttaatcattccacaatataaatatatacgaagacataatactgtacccctcaaaacaattattatttatttaaaacatttaaaaacaaaaaatgagacaaatatcangaaagtaattttatacataagctagataattgcctatagctgcgtatgctgtnaaataatttctgtttgaaaagacgggaaaaattatatggcaaaaccatantgcagtaataaatttgccatgtttagtaaacaaaatatagttcaatgtgactgaagcataccaagaggcaggagaatgtggtgtacactgtantgtagaggagtgtcttagtttgggctgctatacanaataccatagatngagtggcttacaaataacanaaaaagtatttcttactgttctaggggttggaagtccnnagtc

SEQ ID NO: 8563 - DNA, 195 bp, Homo sapiens
  misc_feature (1)...(195): n = g, a, c or t
tccctgcaaatgggacttacgagtttggttatcanatgcactttatttgtaatgagggttattacttaattggngaagaaattntatattgngaanttaaaggatcannagcaatttngagcggtaagcccccaatntgtgaaaaggttttgtgtacaccacctccaaaaataaaaaatggaaaacncaccttta

SEQ ID NO: 8564 - DNA, 195 bp, Homo sapiens
ccatagcttcatccttgcctttcatgcccactaaaaacttaacaagtctagcaggatgttggaatccatctcgaagttcttgtgggtcctcagcaagagcacatgacttatgatataaatcttccatactagggctagccatcagcattacctttgcactgtataagtggtcagcatctggtggatcaagaatgg

SEQ ID NO: 8565 - DNA, 572 bp, Homo sapiens
  misc_feature (1)...(572): n = g, a, c or t
ggttcagtatctgcctcttttaggtcagagtatgctatgagtagcaatacatacatatatttttaaaagttgatacttctttatgacccacagttgacctttattttcttaaataccagggcagttgtggctcattgtgcattttactgttggcccattcatttcgtttttggaaattatggttttgtattttcatgtttatttacattcatttttgtttattcagggaaagctgatctttttttcaaaccagaaaaaaaaatgaactagatatgaagtagagttcattaaatatcttgctattgtcagagtttttaaaatatagacttaattttgtttttttaaattggaatacaataaagtactacctacatttgagtcagtcaccactcttattgtgcaggttaagtacaagttaactaaaaataaactgtcctctctggtgcaactcacaaccaagatcaagattaccttaaaatttatttgaattttttagatgttttggntgncaaactgnaaggaaacttcacaacatttaagtcttactctgtatgtaacnatccatcattcac

SEQ ID NO: 8566 - DNA, 598 bp, Homo sapiens
ctggcagatgcagaagaagcgatgtatcagaatgtggatggccgtgtttcggaatgtcctcacacctaccaaaacaggcgacctttcagcagagagatggatttggggctactctctccgcaggctcaggtcgaagattcgtagaggaacaatttagttttaaggacttcatccctccacctatccctaacaggctgtagattaccaaaacaagattaatttcatcactaaaagaaaatctattatcaactgctgcttcaccagacttttctctagaagctgtctgcgtttactcttgttttcaaagggacttttgtaaaatcaaatcatcctgtcacaaggcaggaggagctgataatgaactttattggagcattgatctgcatccaaggccttctcaggctggcttgagtgaattgtgtacctgaagtacagtatattcttgtaaatacataaaacaaaagcattttgctaaggagaagctaatatgattttttaagtctatgttttaaaataatatgtaaatttttcagctatttagtgatatattttatgggtgggaataaaatttctactacaaaaaaaaaaaaaaaaaaaa

SEQ ID NO: 8567 - DNA, 595 bp, Homo sapiens
  misc_feature (1)...(595): n = g, a, c or t
ccaggctggtctcgaaatcccgacctcgtgatccacccacctcagcctcccaaagtgctgggattacaggtgtgagcaacctcgcccagccccaagtttattaaaaagcactactgcaatacccaacaaattaaagggtaggtactttgaggaagtagagcctgccccctttaaaagcaggacaagctacactttcagaatagggaaaaaatgtatctgagggatttattaacacttagcaagggcaggatttaaatagtttgagcagcaaaagagtttttccagaagttttatttacttttatttaattgcagtctaaacatgtgtcttacagtgagcgttttcatataaataatttacagaaaaaggttatttacaaagccacagatctcattcagttaggtaatatggttttctagttattatgggaaaggttaacacttgattgggtctatacagtgccttaaaattgccctcaccacatgaagctctgtccagatgacaaagagaatgtatacctcttcataagtgactatatatactcctgaatccataatcactctcagacctgtgtgaagcttggttaaggngagat

SEQ ID NO: 8568 - DNA, 417 bp, Homo sapiens
  misc_feature (1)...(417): n = g, a, c or t
agctagantaagntggncatgatgcagaanctnctcaaatgcagnnggcttgtcctgnctcttgccctnatncnggttctggaatcctcagttcaaggntatcctacncagagagccaggtaccaatgggtgcgctgcaatncanacagtaattntgcaaactgccttgaagaaaaaggaccaatgttcgaactacttncaggtgaatccaacnagatcccccgnntgangactgncctttttccaaanacgagaatccaggacttgaatcgtatcttcccactttctgaggactactctggatcaggctnnggctccggctccggctctggatcaggatctgggagtggcttcctaacggaaatggaacaggattaccanctantagacgaangngatgctttccatgacaacctt

SEQ ID NO: 8569 - DNA, 559 bp, Homo sapiens
  misc_feature (1)...(559): n = g, a, c or t
cctggctcttgccctcatcctggttctggaatcctcagttcaaggttatcctacgcagagagccaggtaccaatgggtgcgctgcaatccagacagtaattctgcaaactgccttgaagaaaaaggaccaatgttcgaactacttccaggtgaatccaacaagatcccccgtctgaggactgacctttttccaaagacgagaatccaggacttgaatcgtatcttcccactttctgaggactactctggatcaggcttcggctccggctccggctctggatcaggatctgggagtggcttcctaacggaaatggaacaggattaccaactagtagacgaaagtgatgctttccatgacaaccttaggtctcttgacaggaatctgccctcagacagccaggacttgggtcaacatggattagaagaggattttatgttataaaagaggattttcccaccttgacaccaggcaatgtagttagcatattttatgtaccatggttatatgattaatcttgngacaaagaattttatagaaatttttaaacatctgaaaaag

SEQ ID NO: 8570 - DNA, 594 bp, Homo sapiens
  misc_feature (1)...(594): n = g, a, c or t
tttttttttttttttttttaagaggtgagttctccctttgtgatcacgttgaagtgcagtggngggaccatagttcactatagcctccaaactcgggctccagcgattctcctgcctcaggcttctgagtagctaggactacgggtatgcaccaccatgcccagctaattttttaaaaatgttttcgtanagatgagggtctcactaaggctgcctaggctggtctcaaactcctggcctcaagnggtcctcccactttgaactcctaaagtgttgngattattggtgtaagccactgngcccagcctatanaaatgttttgcncgaatttctggaaccatcanaaaacaccagagtctgccananaagtccccaaatagcacaggaataaatggcataaaatattaataattcatgtctcagcaagggaataggcagagaacacatgttcagcaccagcagtgccaggagctgttattttgacctaacttgctccaaatgaaagtccagacacaatctctcacacaaaattcttcaccggctcaaccataacaagaatagtccctaatagcatttattaagtgctattatgtg

SEQ ID NO: 8571 - DNA, 252 bp, Homo sapiens
  misc_feature (1)...(252): n = g, a, c or t
aaataaaatnaaaaaaggtcnaatgggaagctgaaaaataaatnanagntgactcttttaaaacaataataaattaaacaagcaaaaatcgacncaaattaaaattggaaattacaaaggaaagaaacaacaatcaataaacagttattaaacaaaaaaggttttaaaaaattatgatgaantactatgcacagnngtttggcaatatactatatgtaaangtgtatttaaataaattggcattctccacac

SEQ ID NO: 8572 - DNA, 142 bp, Homo sapiens
ctggggaaagaaagaggaggaagtggaaaaagagtaggaggagggtggttctctccagggcacccttcctgctttgggatggtgactcacccagcaggccctgggagaggcaatttatcagccccaacgaagacaggccagg

SEQ ID NO: 8573 - DNA, 532 bp, Homo sapiens
  misc_feature (1)...(532): n = g, a, c or t
gaggtctggtatagattcanttactaatgcagtanctaagaaaaaatgngacttttcantancttcacngganagttgtgtaagattccaagccatttgcatctggatctggagtngacatgttaactaaagaagtgtnttnctccttcatttctttatcatcactgtaagttttctttgttgttagtacagaataatctgtggttttgagttcagtttcagtaaatgtctgtgaatcaaagattgtttgttctgttgcagganagttttgaggggattcaaatgacttttcttcttgaatttgttcctctgatgttgtttcactttcaatttcttgncttacagggttgacttcttgcctagaccataatttggctggctctatagtttggggaaagtttgntgaaactgtgccactgacctttacttcctccttctctactggagctttcgtaccttccacttctgctgttggtaaaatggtggatcttctatcaatttcattgacagtacccacttctcccaatccttc

SEQ ID NO: 8574 - DNA, 592 bp, Homo sapiens
ggcaacccaaggaaaggaaatcacctcggtcggcagtgtgactgctgagactgccggggctgctgcctgctgcttctcgcgcctgtcctctccaagatgcagttttttgatgctgaggagctcctggtcgatgaagaggatgatgtttttggtgaaggtaaatgcatctttctggcaggaggctctccggtctgctttgctttgttttgacaccactggacacttttgcccagcttgggcaaggacttgagtattttgaaatgataaaaacaaagcatcctgagtgaggtagtggctgcaaatatcaacttaggcactgaaggaatacacaaggcaaggggtggaacaaggggttgagtcattcccgcaaatacattttttaaagtcatgactaaaataaaggtttagtttaggctggaaaatagtactaaattttttgccttgtctctcttctgtgctatctcttgtctaacaccttaaggaaagcctgtcacagtggtttgagcacagcagggctgctagggaagaagttaaataaatggaccaggagtggtttttcatggtaccatgttgctttgatttgcacttctct

SEQ ID NO: 8575 - DNA, 337 bp, Homo sapiens
ccaggaaaaagaaagaaaaacaaaacaaaacagaaaaggtcgatcttgccttgaaagcgggcagtggctattttcttctctctgccaaagcaggacacgttattcttaacacagagggccacatcgctgtccctcacaaatacttcagacagttgtcttcaacatcctgtggttcttcgtccgattccttttttttttttgagatggagtctcgctctgtcccccaggctggagcacagtggtgccatcttgacttactgcaacctccacctcccgggttgaagggattctcctgtctcagtccccccaaatacctgggattacaggcgcccgccac

SEQ ID NO: 8576 - DNA, 255 bp, Homo sapiens
  misc_feature (1)...(255): n = g, a, c or t
tttgtantcttccaagttcagagatctccttggagccccatccttggntggcggagccttggaggtgatggctaaagcctttgactntganctgggaacttgtaagtcaatcttcacatcaaaatcgngtnctttgaacagatcttctaagaggtcactggctgactnanaattcaaatctttatctttgccttgacccttgctcatttnctttggagcatctggtaacactncagaaccgnattttgcattcag

SEQ ID NO: 8577 - DNA, 428 bp, Homo sapiens
ccaaggaatggcattgtgcagaggcataccgggaagctctctggatgcaaccccacctctaccgcttggcagtcaatgaccttggcatgatgtttcttcacttctctgaggctaggtctttgattctgaacatggggactgtaatgcctgcctgacctgtgttagaacagcatgtgtcactgagtggaggtgggaggaatttgtaaactgtgaagtgctagccacacaggtgggaaaggtaagcctatcctgtagagctctgctgccctgacaatgcctgggatttggccttcttttctggagcacactaaggcaatcttggctagtgcatcagacgggagtgagccccagtgactgagtaaatggagaataagacaaggaacacgagcatccggcctgtgcagacatacaagcagaataaaccacag

SEQ ID NO: 8578 - DNA, 551 bp, Homo sapiens
ccagcatttgacagtggaatgtcttcccaggatgtacacattttccccaataatcttgaacacttcccatttacctctagagcatctttcttgtcctgattaaggaggtatccttctcttgctctctctcagttgaggttattttgtaggaaaaaatgattgtagccagggcttgaaagtggcagggaataagtttgagtgtcccctatctttcctcatgacagtgctggagcattagcacaaagcctgtctatcatcatgggaaataatcccacccaaacacactgggaagacgtgagggtgtctccttggtcttattagcctagcagaaggacagaaagatgaagggatgtggggttgcggggaatgagaagcgctgaacacctggaatttgttcccttgggccgacaggttgcagcttgcttgctgttctccctctgtctgagaacacttcgtatttaacactctctaattctgcttgcacatcctctacttccttccttcttttcacctctcaaggtttgtgcccaaatatggctctatttcagctc

SEQ ID NO: 8579 - DNA, 473 bp, Homo sapiens
  misc_feature (1)...(473): n = g, a, c or t
ggtcttgaactcctgacctcangtgatctgtctgtcttggccttctagagtgctgggattacagggttgagccaccgcacccagccgggatataaatatatttaatcttcacaccaactcatgatgtaggttctattataaattccattttatagatgatgaaactgaggcacagcgaggttaggttatttgcctaaaatcgtcacagtaagagacagagcaaggatttgaacccaaacaatctgnctccaganncancgtccttaaccactgttctctcntgcttttttgtaagtacatnnacataattttcaggagaaaggttgtgctagactttgtagaaaaatcttttctcatcctaatgtgagaaatatctgccatggttcaatgtatgtgagtgtgttatatctttcangagtgttggggtgggaaaaaagtttgagaagtactatcctaaagagtattttgtctta

SEQ ID NO: 8580 - DNA, 265 bp, Homo sapiens
ccattttcttttttcaccttaaaggtcaaacatgaaacaatgaggaatgtaggtctttgtaaaacacataaatacctgtgatgttttgaatcatttggcccttaaaaatattgcttaacaagttaaacccagcttaattgtaggtaaatgcaagtatacccaaggctggactattttagtctgcttttggctgcagattgtacttctgtggctggaaaaaatgttcttcaatagcactgaccagttcattcagttccttcttcag

SEQ ID NO: 8581 - DNA, 369 bp, Homo sapiens
  misc_feature (1)...(369): n = g, a, c or t
ggttattcnagtgaccganaccgcggccgggaccgagggtttggtgcacctcgatttggaggaagtanggcagggcccttatctggaaagaagtttggaaaccctggggagaaattagttaaaaagaagtggaatcttgatgagctgcctaaatttgagaagaatttttatnaagagcaccctgatttggctaggcgcacagcacaagaggtggaaacatacagaagaagcaaggaaattacagttagaggtcacaactgcccgaagccagttctaaatttttatgaagccaatttccctgcaaatgtcatggatgttattgcaagacagaatttcactgaacccactgctattcaagctcagggatgg

SEQ ID NO: 8582 - DNA, 588 bp, Homo sapiens
  misc_feature (1)...(588): n = g, a, c or t
ctgagacgggaactgaattcttccccaggaagaaaatacctatacccacaataggtctgcaaaatctcccacaggcacctcttctccctttcttgtggttgtttgttaattggtttgttttgcctaaaagcaagatggcaatcttaatcaaaaagggaagctagatttttaaaataacttaaaaaaaccatttttatataaagcagcaaaaacatatcttcctctctgcagaaagaaaaatgttaacaaggaaacacagcgatgtgaacggactgtccgtcaactcctgctccactggatcccccatccagcttcacctcgagctactccttaactccagcagtgctgtctgaagaagatcctttggcgtcttcaactgctcttttactttcttgattgagactttcattttcggacctggtcccattagggatagagttttcaccgtttacaagcccgttttctgtggcctttgctttgctgattgcctctctgatgttcaaggcatcctgcactccagcctcctcctcgaggtttctcaagaccagggggagcctcgagtcccccacgctgntctccaacagccca

SEQ ID NO: 8583 - DNA, 518 bp, Homo sapiens
  misc_feature (1)...(518): n = g, a, c or t
cttggccatcctgctctttgtatatgaacagaagctgaatgagtatgtggctaagggtctgaccgacagcatccaccgttaccactcagacaatagcaccaaggcagcgtgggactccatccagtcatttctgcagtgttgtggtataaatggcacgagtgattggaccagtggcccaccagcatcttgcccctcagatcgaaaagtggagggttgctatgcgaaagcaagactgtggtttcattccaatttcctgtatatcggaatcatcaccatctgtgtatgtgtgattgaggtgttggggatgtcctttgcactgaccctgaactgccagattgacaaaaccagccagaccatagggctatgatctgcagtagtcctgtggtgaagagacttgtttcatctccggaaatgcaaaaccatttatagcatgaagccctacatgatcactgcaggatgatcctcctcccatcctttccctttttaggtccctgtcttatacaaccaganaagtgggt

SEQ ID NO: 8584 - DNA, 276 bp, Homo sapiens
  misc_feature (1)...(276): n = g, a, c or t
cattgncagttcttgtctagttttcattaaaagaacaaagatcttttatatggatatcttataaatatataatcattgctaagtaagaagttaagttgttgctatcgcaacaatcctggcagacaattgagtaatattttgatgacttattttgtttgtaattagttattataagaagatctagatcctagatattagaataaaatttattttctactgtatccatttcaaatgttaaaatattgnttantatttttgaaatccctgagtatcagg

SEQ ID NO: 8585 - DNA, 389 bp, Homo sapiens
  misc_feature (1)...(389): n = g, a, c or t
ccaggaaaaagaaagaaaaacaaaacaaaacagaaaaggtcgatcttgccttgaaagcgggcagtggctattttcttctctctgccaaagcaggacacgttattcttaacacagagggccacatcgctgtccctcacaaatacttcagacagttgtcttcaacatcctgtggttcttcgtccgattcctttttttttttgagatggagtctcgctctgtcccccaggctggagcacagnggtgccatcttgacttactgcaacctccacctcccgggttgaagggattctcctgtctcagtccccccaaatacctgggattacaggcgcccgccaccacgcccggctaatttttgtatttttaatagagacatgctttcaccatgttgg

SEQ ID NO: 8586 - DNA, 223 bp, Homo sapiens
ctgtttgaccgaacaggtgatggcaagatcctgtacagccagtgtggggatgtgatgagggccctgggccagaaccctaccaacgccgaggtgctcaaggtcctggggaaccccaagagtgatgagatgaatgtgaaggtgctggactttgagcactttctgcccatgctgcagacagtggctggggctctcagccgcccaaggggaggacaacagaggtcag

SEQ ID NO: 8587 - DNA, 451 bp, Homo sapiens
  misc_feature (1)...(451): n = g, a, c or t
tggattggatatggtnggagtggcacanactggatctgggaaaacatngncttatttgcttcctgccnttgnccacatnaatcatcagccattcctaganagaggcgatgggcctatttgtttggtgctggcaccaactcgggaactggcccancangtgcancaagtanctgntgaatattgtanagcatgtngnttgaagtntacttgtatctacggtggtgctcctaanggaccacaaatacntgatttggagagaggngtggaaatctgtattgcaacacctggaagactgattgactttttanagtgtggaaaaaccaatctgngaagaacaacctaccttgtccttgatgaagcanatanaatgcttgatatgggctttgaaccccaaataangaagattgtggatcaaataagacctgatangcaaactctaatgtggagtgcg

SEQ ID NO: 8588 - DNA, 588 bp, Homo sapiens
  misc_feature (1)...(588): n = g, a, c or t
caaattttcctgaagaaaagtaggaaattattatttataagtataattaaagagagatctttaatttcttttttttttttttttgagacggagtctcgctctgtcgcccaggcgcaatctcagctcactgcaacctccacctcccgggttcatgccataaagaaaggtttcttatttggattcagctaatactcatggaatgcattttctttaacacctttttatcataaaatacaatcttttactttggctgtgcaattgatacctttatttttccttaaaatattgtaatagcatagatatatggtatatacttcctgcttgctgtgctgtcttataagaaatccagaaacatagaaacattatggcatttcccagttagtgtttaacaaagtctattagcagatcctagtgattataggataaataacaaacttaattatcagggttaatttaggattatcaaccatatgtttttcattgngaattatcagttggtctatagatggaaaatataagatgtataatgtattancttaaaaaatgctcttcanagagtgnctagaattatagaatttaaaaattttg

SEQ ID NO: 8589 - DNA, 433 bp, Homo sapiens
  misc_feature (1)...(433): n = g, a, c or t
cctcaaccaagagggttgatggcctccagtcaagaaactgtggctcatgccagcagagctctctcctcctccagcaggcgccatgcaagggcaggctaaaagacctccagtgcatcaacatccatctagcagagagaaaaggggcactgaagcagctatgtctgccaggggctaggggctcccttgcagacagcaatgctacaataaaggacacagaaatgggggaggtgggggagccctatttttataacaaagtcaaacagatctgtgcgttcattcccccagacacacaagtagaaaaaaaccaatgctgtggtttctgccaagatggaatattcctcctcctanttccacacatggcgtttgcaatgctcgacagcattgcactgggctgctgnnntctgtgttctggcaccagtagcttgggccccat

SEQ ID NO: 8590 - DNA, 319 bp, Homo sapiens
cctgtgaagtacagtcagaagtacagatggatgaaagaagaaactggcaaagaactgagtggaaggccctgtgaactgggggactcgtggtggaaagctaggccacctcaccctacattcgaccttgaaagacgcagtgtttggcctgctgccctgaagcccacacgtttaccagtggtgcagtgccagcagcatcttgtgagcccctctgaagccaaatgctggcttccctgggggaacaaagtaaagctcctgtttgacaagcttcagacagaggcagtgtctgtgctgccagggagagcccaggctcaggagatgg

SEQ ID NO: 8591 - DNA, 208 bp, Homo sapiens
ctgcagcggctgtgtgtgctgctggatgtttacctggagaccgagagccatgacgacagtgtggaggggcccaaggaatttccccaggagaagatgtgtctgcggctcttcaggggtcctagcaggatgaagccatttaaatacaaccatcctcagggattcttcagccatcgctgatctcccgcgcagaccgttgtttcccccaagg

SEQ ID NO: 8592 - DNA, 597 bp, Homo sapiens
cctcagttgtcacttccacaaaagaggataataaagtactaccatacaaggtcacagtgaggatgaagggcagttcttaacatggcagccaacacacagtaagtgctccctttaagctattcattccaattcttatccagaaagataaccagtaaggactagaaatgtggtcatataaattatgtacagagctgttttcccctcatacttaacccctgcccttgaactcagcaatgagcgagccctcaggggctgtctctgcggggctgcacatgaactgcttgcgtgtataacttgtataacctcccaacgtgcctctcacaatgcatgaggcaggagctctggaactatcagctcccaactcctcaagcccaaagtgaagaaaattcaaaacagtacatatgactgtcaatggtcttcattcatttatatccatattaaaattagtttgcatttcttttacatgtatcttttgatggatgtcagaagaaaattattcagagatttaaaagtgacacagataagccactaaatagataacagataacatagatgagaaatgaaacaactatatgtatattctgaggagttagttaa

SEQ ID NO: 8593 - DNA, 332 bp, Homo sapiens
  misc_feature (1)...(332): n = g, a, c or t
cttgnnttggtaatctacngcctgttanggataggnggagggatgaantccttaaaactaaattgttcctctacgnatcttcgacctgagcctgcngagagagtanccccaaatccatctctctgctgaaaggncgcctgttttggtaggtgtgaggacattccgaaacacggncatccacattctgatacatatttaatcttatgttgatttcaccatgtggctgctcctgcttcanaacttctgcagtgtcccaggacttcttgctgnctttgtgttacccttgnccttgnttttcccaggcatnctctgnggngggntttccctctgcg

SEQ ID NO: 8594 - DNA, 358 bp, Homo sapiens
ggttccctgcccacagaccttccaggagaatgacctgagcaccttctttcccttcatctttgaagaagaacctatcttcttcgacacatgggataacgaggcttatgtgcacgatgcacctgtacgatcactgaactgcacgctccgggactcacagcaaaaaagcttggtgatgtctggtccatatgaactgaaagctctccacctccagggacaggatatggagcaacaagtggtgttctccatgtcctttgtacaaggagaagaaagtaatgacaaaatacctgtggccttgggcctcaaggaaaagaatctgtacctgtcctgcgtgttgaaagatgataagcccactctacag

SEQ ID NO: 8595 - DNA, 583 bp, Homo sapiens
ctgcagttccaggtcctgaagttccattcggactgaatttctcaaaccctggagctgatcaacttcaaacctctcctcctcagtcatatgatgataaaccatggtttgctgacgcagcattgccaattctaaatccatcatttgtgttctaaacaaattcaggctccgcctcattacctggagctcctgaaaagtattttcataaagaggtagaacagatgatttctgagtactatatggagcagcagcaggatcaggtcctctcatcatagggtacttcaaaaaagtaaaagtaggattaaaaccaatgttaaagtgaatacttccaaatcacttaaggggttaaaaggcagaatttggggcctatatatttttctctttaagacaaaaggatccaaaaaaccttcatattgtaagcaggaaaaaagaaatcagttcccaatgactcgagcggccgcccgggcaggtccatggacaagctgaggaagatgctggttccctgcccacagaccttccaggagaatgacctgagcaccttctttcccttcatctttgaagaagaacctatcttctttgacacatg

SEQ ID NO: 8596 - DNA, 418 bp, Homo sapiens
ctgaaaggagagagctgactgtcctggctgatggacaggagatcctcttagcactaccctaaggcaggcagttgggcattggtgtagacaacaggaaagtccaggctatagccgtactcaaaaacctttctgttccctttctgccagccctagggattgagtccacattcagcacaggactctctgggtacagctctctttaggaagacacaaattgcatggtgaagtcagttatatcctggccgcctttggtccctcccaggaagacgggcatgttttctgcttgagaggtgctgatgtaccagttggggaactgggcagactcaaattccagcttgttattgatttctatcttgttgaagacaaatcgcttttccatcttcttctttgggtaatttttgggatctacactctccag

SEQ ID NO: 8597 - DNA, 272 bp, Homo sapiens
cctgctggttgatcccaaatccacgtagaacggttccaactgcagcggggaagatgggctggtttaaaataaaaaaccaggtattgtttcactggtgccagaacacccagctcttcctggtattatggggtctgcagaccaggtggaccccgggaataggcaggggctatagtcgcattttcagaaggtgatctggagccatggaaaatgccctactctctggcagttctaccagccaccctcagaccacagcttccctgaaggctgtgcag

SEQ ID NO: 8598 - DNA, 252 bp, Homo sapiens
ctggcttcccacttcttggtacccggttaactgccaggtgggtgacagtgatgccaggctcgcccactactgcactggacacaacctcaccaatgccaccttcataataatggtcctccacggtgaggatcctgcccttggtggcacgagcgctgtcgagaatgagttttctgtccaggggcttgatggtgaaggggtccagcacgcggatgttgatcttttctttcttcagcagttcggcagcggccaagg

SEQ ID NO: 8599 - DNA, 287 bp, Homo sapiens
ctggtattttgcctaagatctatttaagataaccttttcttatattttttacttaatattgggcataatcgtatcattcaagattaagtctgggttatttctttgataagaactgaatgtggccgggcgcagtggctcacgcctgtaatcccagcactttgggaggccgaggtgggtggatcacaaggtcaggagatcgagaccatcctggctaacacggtgaaaccctgtctctactaaaaatacaaaaaatattagctgggtgtggtggcgggtgcctgtagtcc

SEQ ID NO: 8600 - DNA, 270 bp, Homo sapiens
  misc_feature (1)...(270): n = g, a, c or t
ctgcgggggctgcacgctctggagctccgtgaagttgttctcggcgaagctctcgaactcgctgtgcacgtggtgggggtggaagtcccagtaatggtcgctatggctctccccatcactgctgagataggggtaatactcgtgcgtttgncntnggtatagatccgtgtcatagggcaccangtcttctgatggaggggggacnaggggaaacccttccattttgcacgcctgtaacatccagccgggctccnagtcggtcagatcccc

SEQ ID NO: 8601 - DNA, 327 bp, Homo sapiens
ctgagttgctttaccttatcccacctggctcttacgcagtctgttccaagtgagaagttagcagagtcctgtaaacaaagaacagttcaggggccaacctgcgctcccaggtgccaggatgctctcagggtcttcactgtgctcccaggtgccagggtgctcccatggtcttcactgtgctcccagacacttggcttcattgttctcattttgatcctcatttggcatctctaaacgcaggcggtgcagggaatgcacaaagaagcgaggaagtttgcagaccaagttgagttcctccttcccggaccccagggcaggcaggatcag

SEQ ID NO: 8602 - DNA, 549 bp, Homo sapiens
ccgcgcgctgcacaatggcggctctgaagagttggccgtcgcgcagcgtaacttcattcttcaggtacagacagtgtttgtgtgttcctgttgtggctaactttaagaagcggtgtttctcagaattgataagaccatggcataaaactgtgacgattggctttggagtaaccctgtgtgcggttcctattgcacagaaatcagagcctcattcccttagtagtgaagcattgatgaggagagcagtgtctttggtaacagatagcacctctacctttctctctcagaccacatatgcgttgattgaagctattactgaatatactaaggctgtttataccttaacttctctttaccgacaatatacaagtttacttgggaaaatgaattcagaggaggaagatgaagtgtggcaggtgatcataggagccagagctgagatgacttcaaaacaccaagagtacttgaagctggaaaccacttggatgactgcagttggtctttcagagatggtagcagaagctgcatatcaaactggcgcagatcagg

SEQ ID NO: 8603 - DNA, 201 bp, Homo sapiens
ggatgccgccatccagagggcagaggtccaggtcctggaaggagcacttcatctgtttagggccatcagcttcaaagaacaagtcatcctcattgccactgtaataagccatcatttcactggcgagctcaggtacttctgccatggctgcttcagacacttgagcaatgaagattggctgaagagaatcccagagcagcc

SEQ ID NO: 8604 - DNA, 556 bp, Homo sapiens
  misc_feature (1)...(556): n = g, a, c or t
ccaccatccttgggaccgcctgcctggccttacctccttcttgcccattcagatgcactggtaccgggccacccaccaggaagccatcaactgctatgccaatgagacctgctgtgacttcttcacgaaccaagcctatgccattgcctcttccatcgtgtccttctacgttcccctggtgatcatggtcttcgtctactccagggtctttcaggaggccaaaaggcagctccagaagattgacaaatctgagggccgcttccatgtccagaaccttagccaggtggagcaggatgggcggacggggcatggactccgcagatcttccaagttctgcttgaaggagcacaaagccctcaagacgttaggcatcatcatgggcactttcaccctctgctggctgcccttcttcatcgttaacattgtgcatgtgatccaggataacctcatccgtaaggaagtttacatcctcctaaattggataggctatgtcaattctggtttcaatccccttatctactgncggagcccanatttcanaattgccttccaggag

SEQ ID NO: 8605 - DNA, 587 bp, Homo sapiens
ctgtgttggtagtaagtgttttgggtataaggtataaaacagaaattagatcagaaaagtgcagggggaagaccactgccaaagagtaatctccaagaacttggtattttccaccgtgaggcagatactgtggggtcatcgctaagtggtttgagtatctgaagccactcattaagatactcaacaagacctaatgcatctgggatgttgtccccttctgaaacaaatttcagcagaactgccatttggatttctttagaacagctttcatcatagagtgtttttgtgatacctcctcccggaatgcggatacaaaactcggaatcatctatttcaggaatgcaccggcttttttccatttcttcccagttaaggctctttattttattttgaacacttttttgcatggaaggtgtaagtaggtaccggaagggagtactacgaagctgcagatcattacgctgatatgaatgactgcttgaaagaacaatgactctggcacagccactgcttttcacccaggaaagcagtttttcacagaatggctttgatttatacttaataaaaatggatcttaactgtagagc

SEQ ID NO: 8606 - DNA, 499 bp, Homo sapiens
  misc_feature (1)...(499): n = g, a, c or t
ccttttggggataaaacagtttctcttaagtggtgaaaaagctacattttgttctttcagtctaatcttgttttctgctatgattttcttgcgctgttccagataaggtccaaaacttggcagtttcttgtccatgagttcagctatacgtggaactggtttccctttctggtgactcacagtanctggactctgtccatcccagncttgtanttcttcaatgcttttcanataaagcagggctttgaggccagtgcagtagtcttcgatcacagtgaaatcctgattctgaatggcactgcatacctggaggacggaagcaccactatggagaaactgaagaccactttcagcagagtcaattccaccagtagccaaaatgggaaatccaggcagagcacgagcaatggaggtcacagctctcaaagcaataggtctgattgctgtcccagacactnctccatatgtagttcgctttgcaatccccactgntggccaa

SEQ ID NO: 8607 - DNA, 550 bp, Homo sapiens
  misc_feature (1)...(550): n = g, a, c or t
ccatatcatgtaccaaaagttgctgaagtttctcttctagctggtaaagtaggagtttgcatgacttcacactttttttgcgtagtttcttctgttgtatgatggcgtgagtgtgtgtcttgggtaccgctgtgtactactgtgtgcctagattccatgcactctcgttgtgtttgaagtaaatattggagaccggagggtaacaggttggcctgttgattacagctagtaatcgctgtgtcttgttccgccccctccctgacaccccagcttcccaggatgtggaaagcctggatctcagctccttgccccatatcccttctgtaatttgtacctaaagagtgtgattatcctaattcaagagtcactaaaactcatcacattatcattgcatatcagcaaagggtaaagtcctagcaccaattgcttcacataccagcatgttccatttccaatttagaattagccacataataaaatcttagaatcttccttgagaaagagctgcctgagatgtagttttgntatatggntccccaccgaccatttt

SEQ ID NO: 8608 - DNA, 93 bp, Homo sapiens
ccaatctgtcaggagcagaagtgacagggcatttaaacaccactaagagatcctctgattctccttgcccatcagctcagcacctcagaccag

SEQ ID NO: 8609 - DNA, 222 bp, Homo sapiens
  misc_feature (1)...(222): n = g, a, c or t
gaaaanntgggaggtnaactttcctctgaagataaggagaccatggaaaaagctgtanaanaaaagatngaatggctggaaagccnccangatgctgacatngaagacttcaangctaanaanaaggaactggaagaaattgttcanccaattatcagcaaactctatggaagtgcangccctcccccaactggtgaanaggatacagcananaaagatgag

SEQ ID NO: 8610 - DNA, 592 bp, Homo sapiens
  misc_feature (1)...(592): n = g, a, c or t
ctgaagacaagggtacagggaacaaaaataagatcacaatcaccaatgaccagaatcgcctgacacctgaagaaatcgaaaggatggttaatgatgctgagaagtttgctgaggaagacaaaaagctcaaggagcgcattgatactagaaatgagttggaaagctatgcctattctctaaagaatcagattggagataaagaaaagctgggaggtaaactttcctctgaagataaggagaccatggaaaaagctgtagaagaaaagattgaatggctggaaagccaccaagatgctgacattgaagacttcaaagctaagaagaaggaactggaagaaattgttcaaccaattatcagcaaactctatggaagtgcaggccctcccccaactggtgaagaggatacagcagaaaaagatgagttgtagacactgatctgctagtgctgtaatattgtaaatactggactcaggaacttttgttaggaaaaaattgaaagaacttaagtctcgaatgtaattggaatcttcacctcagagtggagttgaaactgntatagcctaancggnttgtttactgcttttcattagca

SEQ ID NO: 8611 - DNA, 499 bp, Homo sapiens
  misc_feature (1)...(499): n = g, a, c or t
ccttttggggataaaacagtttctcttaagtggtgaaaaagctacattttgttctttcagtctaatcttgttttctgctatgattttcttgcgctgttccagataaggtccaaaacttggcagtttcttgtccatgagttcagctatacgtggaactggtttccctttctggtgactcacagtagctggactctgtccatcccagtcttgtagttcttcaatgcttttcagataaagcagggctttgaggccagtgcagtagtcttcgatcacagtgaaatcctgattctgaatggcactgcatacctggaggacggaagcaccactatggagaaactgaagaccactttcagcagagtcaattccaccagtagccaaaatgggaaatccaggcagagcacgagcaatggaggtcacagctctcaaagcaataggtctgattgctgtcccagacactcctccatatgtagttcgctntgcaatccccactgctggccaa

SEQ ID NO: 8612 - DNA, 590 bp, Homo sapiens
  misc_feature (1)...(590): n = g, a, c or t
ctgaaaaagagtgatcctcaatatcctaactaactggtcctcaactcaagcagagtttcttcactctggcactgtgatcatgaaacttagtagaggggattgtgtgtattttatacaaatttaatacaatgtcttacattgataaaattcttaaagagcaaaactgcattttatttctgcatccacattccaatcatattagaactaagatatttatctatgaagatataaatggtgcagagagactttcatctgtggattgcgttgtttcttagggttcctagcactgatgcctgcacaagcatgtgatatgtgaaataaaatggattcttctatagctaaatgagttccctctggggagagttctggtactgcaatcacaatgccagatggtgtttatgggctatttgtgtaagtaagtggtaagatgctatgaagtaagtgtgtttgttttcatcttatggaaactcttgatgcatgtgcttttgtatggaataaattttggtgcaatatgatgtcattcaactttgcattgaattgaattttggttgnatttatatgtattatacctgncacgcttctagttgctt

SEQ ID NO: 8613 - DNA, 591 bp, Homo sapiens
  misc_feature (1)...(591): n = g, a, c or t
ctgacacaggctgcaaacaaatgtcctctcatcctcaccgcaatccctacaagctgctcacctcctgttgccatgtggatgtgtcctgagtggcccacgcagatttctacacttgatcccctcgcttgaaataaaaggagataaagtgagtacaaacacccttatgtattactgtagctcaaacgaggccagactagatcctaaagaagacctggcgtgggccatcttctagagtcatcccacctcccaggacaagcaaaggtcctgcctccaagtcattgcaacttatatgacacagcaaggcaatatagactctgggggaaaaagttttttaactacagtatttttaaaatagaacattattttgaaattacttcgacatctactgtcaggtgacttgtaaaagcgcttgtatgttaaatgctctacattaggagattattttgttcttgagtccctacagagaattccttgggaatgaagtgctattgngcattcagaattatgtggctatagccatattgcaggccgggaactcaggaatgtcccctctgtcccagctcttcaagttgggccctacagatcccacgg

SEQ ID NO: 8614 - DNA, 394 bp, Homo sapiens
cctactatgggtgttaaattttttactctctctacaaggttttttcctagtgtccaaagagctgttcctctttggactaacagttaaatttaccctggctcaacaaaagggctggggattggccctgaaaggagagagctgactgtcctggctgatggacaggagattctcttagcactaccctaaggcaggcagttgggcattggtgtagacaacaggaaagtccaggctatagccgtactcaaaaacctttctgttccctttctgccagccctagggattgagtccacattcagcacaggactctctgggtacagctctctttaggaagacacaaattgcatggtgaagtcagttatatcctggccgcctttggtccctcccaggaagacgg

SEQ ID NO: 8615 - DNA, 558 bp, Homo sapiens
  misc_feature (1)...(558): n = g, a, c or t
ccaagggctaagagagaagagattgcatttaagataccctttggagtctggaaagcacctggatttcttgggagaggagcctggatttcttgggagaggagggctgtggaagccccaatcagttcttcttcgttttgggagtgtcatatttcctcttgctggagtaccacaatagcagggggatgccgatggagggaagggtcatgaccccaaaggctgcccagtccagaaaatgaggggagaatcgcctgtcaaactcccgctgagccaggattcctccctgtccaggtgcactggtagagccaatcacaacgggcccatcctcctgggccaggtaagtaattgttgccgaggtgaagttgaaataaccagccttgagagggcgcaggaccacagtgtgggagacattgctagcaggggcaatccggtcccatttgacattgagcattccagacacaatgccaaagtcttctggagggaaggaatcatcagatagttccacgtctaatgcancacttgagccaacattgtagatgttgtactgcaaggtcaggtctc

SEQ ID NO: 8616 - DNA, 420 bp, Homo sapiens
  misc_feature (1)...(420): n = g, a, c or t
ctgttcttctttttgttcctgacatttcagctcttcttctaaatgtctgtcttcttgaaggctggaaattaccttcttctcatgaccagaatccaaagagatttctaaatcccactttttctttcttttcagttctttacgtattgtcacccagagaacagtgttcactaaaaacattattcccactgccagatagaaaaggacatgaaaccagacaggagttggtaactggaggccaagcacttgaagctccaactcagggctgcgcttaaggacatttccatcctctgtggcagcctcgcaccantataacccagagtcttctcttctagcagttagtatttggtattcagaggatgtgttcctgcctcgcggggtcttgctgcccatgtanaaggagaagtaaagctgcaaaccagg

SEQ ID NO: 8617 - DNA, 183 bp, Homo sapiens
cctttctgtttgatgcctgctcgggaggttggcttcagctccaggctttcctgatccgtggcatccaggatcttgtacttgcttttcctcttgggttttcctttttgcctcttacaacaacagatcacagtccaagacaggattcccaaggcaacaacaatgacaaaggtagcaatgataaca

SEQ ID NO: 8618 - DNA, 307 bp, Homo sapiens
gtcctggcagatgctctcaagagtatcaacaatgccgaaaagagaggcaaacgccaggtgcttattaggccgtgctccaaagtcatcgtccggtttctcactgtgatgatgaagcatggttacattggcgaatttgaaatcattgatgaccacagagctgggaaaattgttgtgaacctcacaggcaggctaaacaagtgtggggtgatcagccccagatttgacgtgcaactcaaagacctggaaaaatggcagaataatctgcttccatcccgccagtttggtttcattgtactgacaacctcag

SEQ ID NO: 8619 - DNA, 411 bp, Homo sapiens
ctgggcaagaaatgcctcaggaggtttttatttttcctcttcagatagatgttgcttcctgccaattgcatcctgtacccactgttccttctggattccatgatttaccatccagcagggcttttctgagtcgtctccagaagatgtgccgccccaggacactgtcctcccactccaggtaagtgttcctgctgagaaggcggtacagctccacctgctgcctgagcagggtcttctccaccttctgcaggacaatgaagatgataccagcacgactgctcagaaactgccaggtctgagcaatctcatattcaaagatacaccagcggctctggatgaagtgctgggacaccacaacaatcacctttcggcttttatggaaaccttcatggatgatgttggcagcaatgg

SEQ ID NO: 8620 - DNA, 399 bp, Homo sapiens
ccatgtctagagccagacttggactttatatcttcgccagagtatccctcttccaaaactgttttgaactgactccagctttcagtcagctcacagctcgcccccttcatttgcatataattccaacagaacctttcccaactactagaaagaatggagagagaccatctcatgaagtacaaataataaaaaatatgccccagatggcaaactttgtatacaacatgtacatgcatttgatacagactacacatcattatcatcagactttattacaactaccacctgctatggtagaagagggtgaggaagttcaaaatcaagaaacagaattggaaacagaagaagaggccatgactgttcaagctgacatcatacccagtccaacagacaccagat

SEQ ID NO: 8621 - DNA, 252 bp, Homo sapiens
ccttggccgctgccgaactgctgaagaaagaaaagatcaacatccgcgtgctggaccccttcaccatcaagcccctggacagaaaactcattctcgacagcgctcgtgccaccaagggcaggatcctcaccgtggaggaccattattatgaaggtggcattggtgaggctgtgtccagtgcagtagtgggcgagcctggcatcactgtcacccacctggcagttaaccgggtaccaagaagtgggaagccag

SEQ ID NO: 8622 - DNA, 546 bp, Homo sapiens
  misc_feature (1)...(546): n = g, a, c or t
ctggtgtcaagacctgggttagaggtttgtcaaacagaggcagggcccagtcacctctttggaggggagtgatgagaaggggattttggtcacctgagagggttgagtaaacttggatcagggcacaggcttctctcaccatactcagctttttgcactcactccctagttgagcctactggcatcaagctctagatgccaaggctgggatggctgtggagcaggagctatggcccaagtagctctgagaggggaagagacctaaaacccctagcagggaaaatactgacgctaggtgtgaacatatcctctcttttcacaagagtcctgatggggctggctgagcttttgggtactcatccctactgttatagctggagaggatttgggtattgaagcagggaggggcagatcccacgaagtgactgcagatctggaataataagtaaggggtagatctgcccatagagctcactttanaccggcctatactcctacaaggaattggggtaggatcttntactcagccttgccacaatagaatgg

SEQ ID NO: 8623 - DNA, 443 bp, Homo sapiens
  misc_feature (1)...(443): n = g, a, c or t
agtgtaantcccaaaaattacccaaagaagaagatggaaaagcgatttgtcttcaacaagatagaaatcaataacaagctggaatttgagtctgcccagttccccaactggtacatcagcacctctcaagcagaaaacatgcccgtcttcctgggagggaccaaaggcggccaggatataactgacttcaccatgcaatttgtgtcttcctaaagagagctgtacccagagagtcctgtgctgaatgtggactcaatccctagggctggcagaaagggaacagaaaggtttttgagtacggctatagcctggactttcctgttgtctacaccaatgcccaactgcctgccttagggtagtgctaagaggatctcctgtccatcagccaggacagtcagctctctcctttcagggccaatccccagcccttttgttgagccagg

SEQ ID NO: 8624 - DNA, 252 bp, Homo sapiens
ctgcccagtgagtgtgtgaggggctggtctgtttaactgcttgccctgaaggtgcgaggagagcctgttcgccttgcatccagtgggccaagcttacatagatcccatctcctctgcataccctcagcatcctgatctataaaatgggagtgaatatagcaccttcagccacaccaccagcctgcctgcggcccctgcctcctgcccggcctcctctgaggtcagtgccttcagctcctgctgcactggtgg

SEQ ID NO: 8625 - DNA, 383 bp, Homo sapiens; identical to SEQ ID NO: 7515

SEQ ID NO: 8626 - DNA, 495 bp, Homo sapiens
  misc_feature (1)...(495): n = g, a, c or t
cctggccggcttgatgggactcctggagaaagggcttgggggtcccgagcttctcgatcctcttggaggaatgggggtagtctttcctttgatgctgctgtggccctagcccgggaccgccaaaggactgaggctcaaggagttcggcgaacccagacctgtactgagggtggggattactgcctcatccccagaacctccccttgtagcatgatctctgcccattctcctcggccccttagctgcctggagctcccatctgaaggtgcagaagggtctggatcccggagtcgtcttantctgccccccagagaaccccaggttcctgaccccctgttgtcctctcagcgcagatcatatgcatttgaaacacaggctaaccctgggaaaggtgaaggactgtgattaggaccacagccctgggcaaaggggaccagcaagttgtcttgaatctccagggttcctgactagctgtctcctctgcagcatgagcag

SEQ ID NO: 8627 - DNA, 569 bp, Homo sapiens
  misc_feature (1)...(569): n = g, a, c or t
ccatcttgagtcttggtgggcttggcaagtaaggagacattgaccagattcaaagcttccagaggtggtgagaactccagggccgagtaatggagagtacaaaggtccttcttggcccccatgacccttccaagccaagaacttggcagtagctgtgagaagcagagatagggagaggaggtgaggggcacctatagctcttagccatgagttatgactccctccatccaagggagacccaaggacatgaaaggggactcagttccaaggatcagagggaacttgggttgttttgggataatgactgtggcttgggatgtcacggagatgaacaccagaattggtgtgcaacagatgagctccagtacccctgatagtttgcatgggttttgctctgctgatgatggtcagggacagcagtgaggccctctacaatgccgccttctgcctaaacacaggcagtgcccacaaaaggggagctgtcattatggagcctaggaatggatagtcagagagcagcggctgggcagtgcaactcctgcattggacaangtcctggctagagaatg

SEQ ID NO: 8628 - DNA, 398 bp, Homo sapiens
  misc_feature (1)...(398): n = g, a, c or t
tacaagcttttttttttttttttttttttttttttttagggaagtttatttcanaaccattgaacagtatgatatttgctcatttataaatattcccatttaaataatctgagcttatatattttcagtgttaattaaaggacttgatttaaaganagcncaccagtccaaattgaattgattccatagctnttaaaaactaggctcttttacanacactgntacttnttgccccctttgaataaattanaccaatgaataaaacaaacaaacaaataaataaataaatagggaagcggttgctcatcaaaatgngggagcgaatgacanagggtttcttaaaaccaaatgtggccgnggtttntgtcaggngggctttaagtgagtagganaggtga

SEQ ID NO: 8629 - DNA, 558 bp, Homo sapiens
  misc_feature (1)...(558): n = g, a, c or t
ccagtggaatgatgttccctgcaattaccatctcacctatacgtgcaagaaaggaacagttgcttgcggccagccccctgttgtagaaaatgccaagacctttggaaagatgaaacctcgttatgaaatcaactccctgattagataccactgcaaagatggtttcattcaacgtcaccttccaactatccggtgcttaggaaatggaagatgggctatacctaaaattacctgcatgaaccgtaagtggtcctttagaaagaatggactaccgtgctataacaactactagacaccttcattttacggctgtggtatcggcagtttagggtatggagcaagtaatattgngtgttttctttttttctttctttccttccatgtagcatctgcataccaaaggacttattctatgaaatactttaaaaattcctcatcagcaaaggacaattcaataaatacatccaaacatgatcatcgttggagccggaggtggcaggagtcgaggcgctgatccctaaaatggcgaacatgtgttttcatcatttcagccaaagt

SEQ ID NO: 8630 - DNA, 589 bp, Homo sapiens
  misc_feature (1)...(589): n = g, a, c or t
ctgggaagccacgagaatattgtgaacctgctgggggcgtgcacactgtnaggaccaatttacttgatttttgaatactgttgctatggtgatcttctcaactatctaagaagtaaaagagaaaaatttcacaggacttggacagagattttcaaggaacacaatttcagtttttaccccactttccaatcacatccaaattccagcatgcctggttcaagagaagttcanatacacccggactcggatcaaatctcagggcttcatgggaattcatttcactctgaagatgaaattgaatatgaaaaccaaaaaaggctggaagaagaggaagacttgaatgtgcttacatttgaagatcttctttgctttgcatatcaagttgccaaaggaatggaatttctggaatttaagtcgtgtgttcacagagacctggccgccaggaacgtgcttgtcacccacgggaaagtggtgaagatatgtgactttggattggctcgatatatcatgagtgattccaactatgttgtcaggggcaatgcccgtctgcctgtaaaatggatggcccccgaaagcctgtttgaaggca

SEQ ID NO: 8631 - DNA, 453 bp, Homo sapiens
gtacaactagaggaaagcggaagagggttgatgtggaagaatcagaggcgagtagtagtgttagcatctctcattccgcctcagccactggaaatgtttgcatcgaagaaattgatgttgatgggaaatttatccgcttgaagaacacttctgaacaggatcaaccaatgggaggctgggagatgatcagaaaaattggagacacatcagtcagttataaatatacctcaagatatgtgctgaaggcaggccagactgttacaatttgggctgcaaacgctggtgtcacagccagccccccaactgacctcatctggaagaaccagaactcgtggggcactggcgaagatgtgaaggttatattgaaaaattctcagggagaggaggttgctcaaagaagtacagtctttaaaacaaccatacctgaagaagaggaggaggaggaagaagcag

SEQ ID NO: 8632 - DNA, 553 bp, Homo sapiens
cgagcagacacattccgaatactaaaattccttaggaaaattagtcattgcccatgtgtgatagctgttttccattttgaattttaaccattttgggaaaaggaagagaatgggaaataccagtatagtccgaaaagcccttaaaaaatgagtgcgaaaagtggaagggtggagtggacataggaagatgatgaacttgtcattttttcctttccatagcttcattttattgtgtcaaagttgcagaaagcacttcactttcatcgaggctctttttaggcagggtacagccaagaaaacttttttatggctcagatgtaaatcctagaaaacgtagtagaaatgatggcaggatctctaactgtaaaataacagtagtgttagtagtaagtgtcattataataacgttatagaactctgcacatcaaaaataccacattttatcatgatctctgcaagagatttctgttggtagtcattctagacttctaataaataatacgttgagtaggaaaggttctgtgaggatccaaataataatgaaaatgacagt

SEQ ID NO: 8633 - DNA, 356 bp, Homo sapiens
cctttcaccacaactcggatgtggatcacgcccttttgtttagctctcgccgctgcggctatgcctgctgtctgtgctgcgatgcctgtgcccttcttggcattccgaaatccctctgtgccacaggaagcaaaggcaaggggctcattactagcagagactacctggatctgtgtgttgttgtgggatgctttaatgtgtgcaattgggatctcctcaaatttctttcctgcccacctcagagagctctcctctcctgaacttggtgtggctgggagccgcgttctgttcaactttctgcttggccgcagcgtcttggagctgtcgagcgcctgtgcagatggtcccggccggcg

SEQ ID NO: 8634 - DNA, 244 bp, Homo sapiens
gctcacctcactaaccagtatatgcagagaatggcaagtgtacgagctgttcccaaccctgtaatcaacccctaccagccagcacctccttcaggttacttcatggcagctatcccacagactcagaaccgtgctgcatactatcctcctagccaaattgctcaactaagaccaagtcctcgctggactgctcagggtgccagacctcatccattccaaaatatgcccggtgctatccgcccag

SEQ ID NO: 8635 - DNA, 435 bp, Homo sapiens
  misc_feature (1)...(435): n = g, a, c or t
ctgaaacttatttttatattcattccataaatactgatcacatatctttttctgggtgcttagagtacattaaagaacaaaacaaagattgctgccctcttgtagcttatactctgataaggaaaaacaagcaataaatacaagtgaattttatagtatattaaatgatgatgagtgctttgaaaaaattgaaaggtagatcaggataatcggggtgggataagcattatatgtagcgggtttttttggttggttttttttttttttggtttttgnntttttgagatggagtctcgctctgttgccnnggtatagtggcacnatctnagctcactgcaacctccagctccctggttcaagtgattatnctgcctnagcctcccgagtngctgggattacaggcacatgcctccatacccagctaatttttgtatt

SEQ ID NO: 8636 - DNA, 552 bp, Homo sapiens
ctgagctttgtgaccagtgccagggtttatgaaacattatacatctaaaaaaaaaaaagtaaaaaaagaggcatttaacaataatcagacacatccacacattaaaactgatttccactgctgatttatacattatctagttgtttaaaaatcgcaatcaacatcccaacatctttttaagagtacaatgggcaaagatcaaagacagataaataataatataataaattagagcatgtaatacatcctatgggaattgctgaatcaacattattttccattggggggtatatatttttggtttatctttatcttttctgctgttattttttttctctgcttgataaaatggggctcattcctaaagccagcttgctgagacactaatttcagaagctcacttgtcacttgtttaacctctgagaatactcaggaacacatggttcccagcagcttgggctgggtctttatggaagtgaaatgcacatagatgaacacacgcactcacgtgcgcacacacaccacacacacacacagacacgcagtcacaca

SEQ ID NO: 8637 - DNA, 509 bp, Homo sapiens
  misc_feature (1)...(509): n = g, a, c or t
ccacaagctgatggttactagaactaggngtctgaagtttaaaattctacacnataaaatatctaaaaaatttgtgtcacagaatttcaatagcaattaaattcangaaaagatattcaaatgtcttaatagcaattaccanataataaaaagttattgnaaaagaaaacctttgngttacagattttcactgaattcagacttataaagaattatgcaaatgtatgtaagagtaattattgattaatagattaacagtatttaggaaaaccctatgatgtcataaaagttaatggaaactgtatacgattacagtaagtaataaaattatgtnataaatctttccatactaaaattgttgttttcaaanaagtgaacttcattgttaacattgcgggcacaaagagtttcatcttctgaccangatggacaccaattttgcatttttttctggatgaaagatttcaaacatgtcccagttttcacatcataaagntgtangttgggta

SEQ ID NO: 8638 - DNA, 515 bp, Homo sapiens
ccacaagctgatggttactagaactaggtgtctgaagtttaaaattctacacgataaaatatctaaaaaatttgtgtcacagaatttcaatagcaattaaattcaggaaaagatattcaaatgtcttaatagcaattaccagataataaaaagttattgtaaaagaaaacctttgtgttacagattttcactgaattcagacttataaagaattatgcaaatgtatgtaagagtaattattgattaatagattaacagtatttaggaaaaccctatgatgtcataaaagttaatggaaactgtatacgattacagtaagtaataaaattatgtcataaatctttccatactaaaattgttgttttcaaagaagtgaacttcattgttaacattgcgggcacaaagagtttcatcttctgaccaggatggacaccaattttgcatttttttctggatgaaagatttcaaacatgtcccagttttcacatcataaagttgtaggttgggtatcccag

SEQ ID NO: 8639 - DNA, 351 bp, Homo sapiens
  misc_feature (1)...(351): n = g, a, c or t
ctgatggttactagaactaggtgtctgaagtttaaaattctacacnataaaatatctaaaaaatttgtgtcacanaatttcaatagcaattaaattcaggaaaagatattcaaatgtcttaatagcaattaccagataataaaaagttattgtaaaagaaaacctttgtgttacagattttcactgaattcanacttataaagaattatgcaaatgtatgtaagagtaattattgattaatagattaacagtatttaggaaaaccctatgatgtcataaaagttaatggaaactgtatacgattacagtaagtaataaaattatgtcataaatctttccatactaaaattg

SEQ ID NO: 8640 - DNA, 249 bp, Homo sapiens
  misc_feature (1)...(249): n = g, a, c or t
aaaggcanngccctggtacctgacagtgtaaagaagganctcctacaangaatnanaacattccttgctcagcatgccagcctttaagattgaattanattgtgttgntgtggntttatttctgaaagtaaaacttgccataaattagaaaacaatttcccaaaataaaatccttttttgtatgatggtatacagttttcagtaatgatgtatacattgtattgatttttttcccntaaatgngttatt

SEQ ID NO: 8641 - DNA, 257 bp, Homo sapiens
  misc_feature (1)...(257): n = g, a, c or t
ctgggactgaaaccccgcacgcagccgccggagtttccaaactgcgatcccttctcacccaaagaaacaaggggagtatgatccatgatcaacaacatgctaaagttaaacaagaaaatggtacaaaatagaaattattaccatacatgtccagcatgcaggattaatatttttaatgcagattttttgtattnttctatataatcgagcaggcaataaaactgatgagatttgggcgccgagcgtcctaactgagg

SEQ ID NO: 8642 - DNA, 376 bp, Homo sapiens
  misc_feature (1)...(376): n = g, a, c or t
ctttgacctatatttggtgtggcttctatcctatgaaaagggaattgagtgttttgactcgtcgtttcccacctgttgggcctgtctgtaggtataccttctaaaatcaactgacatctccattttgctacagagtagcaaaaatcaacaatttttaagcatactaatggtgtgcatttgatctgaaccttcttgatgctatcatgtttcanctgtgaatatagcctgtcanatgcttagaacaatcagttgaactggtatgagtggctgcattanggctttacaaatcgnnaggactgaattttggtgggtttagagagtgcatttttatagctgagtngaatgnnatgagttcactacaggcttttggcaaagg

SEQ ID NO: 8643 - DNA, 542 bp, Homo sapiens
  misc_feature (1)...(542): n = g, a, c or t
ttggtctanagctttataaggccattcagcgagggaccatcaagtgcaactttgcgggggttgccttgggtgattcctggatctcccctgttgattcggtgctctcctggggaccttacctgtacagcatgtctcttctcgaagacaaaggtctggcagaggtgtctaaggttgcagagcaagtactgaatgccgtaaataaggggctctacagagaggccacagagctgtgggggaaagcagaaatgatcattgaacagaacacagatggggtgaacttctataacatcttaactaaaagcactcccacgtctacaatggagtcgagtctagaattcacacagagccacctagtttgtctttgtcagcgccacgtgagacacctacaacgagatgccttaagccagctcatgaatggccccatcagaaagaagctcaaaattattcctgaggatcaatcctggggaggccaggctaccaacgtctttgtgaacatggaggaggacttcatgaagccagtcattancattgtggacganttg

SEQ ID NO: 8644 - DNA, 382 bp, Homo sapiens
  misc_feature (1)...(382): n = g, a, c or t
cctgaatctgatgcaccgtcttctgctcgtgccatggtttttgtttttgttttttcttaattgagtcatctttacttaaaaatgctaatttccagcttcacttgtaagatcagaatatctgaaaacactttacacttattccaaaatgactccaactggttggagctaagtanaacttagagcctatgatgattaattttatgtgttgatttgactgggctaangggtgcccanatagctgggaaaacaatatctntgggtgtgcctgtganggcgtttctnnaacaggtgttaatnagtngactgantaaagaanatccaccctnaccaatgtgaataggcctcatccagnccattgagggctcaaataaaacaaacaggc

SEQ ID NO: 8645 - DNA, 554 bp, Homo sapiens
  misc_feature (1)...(554): n = g, a, c or t
ccaagatggttggggcataccttggttttatacattttagggagacataagacattaatcaatatatgtaagaagaacattggttcagtggggagggagcttccaggtcacagataggtgagacacaaacagttgcattcttttgagtttctgattagcctttccaaaggaggcaatcagatatgtatctatctcagtgagcagagagataactttgaatagagtgggaggtgggtttgccctaagaagtttccctaagcttgagttttccttagtgattctggggccccaagatattttcctgtcacagttgacatccccaacacagtgtttagggctcagaaaaagataccctaaaatagggtgctttggcatgctgaatgctttgaataaaggaggctgaagggcctcagaaataagagaacaaaggtctgtctctgacccactgctgcccacctcccttcccttccaaagcacagggagggattttctttgaagttctcttatttgattaagggaanntttctccanaaggaaggnaattgtcctggaca

SEQ ID NO: 8646 - DNA, 260 bp, Homo sapiens
gaggttgcggtgagctgagactgcgccattgcactccagcctgggcaacaagagcaaaactccgtctcaaaataaataaataaataaataaataaataaataaataaataaatataaataaaagtagtgggttgatacggtccaatttatttgtcagagatcaccgtggctcttgggtagagaatggatttgaagctggcctaacctagaattggacagacaaaatgggaggctgttgcagtaatctagatggtggatgg

SEQ ID NO: 8647 - DNA, 269 bp, Homo sapiens
ctggccgtctggtgctcgctggtcctgtccttctgccgcctgcacaaacagtccagcatgacggtgatggaagctcaggagagcccgctcttcaacaacgtcaagctacagcgaaagcttcctgtggagtcgatccagattgtattagaggaactgaggaagaaagggaacctcgagtggttggataagagcaagtccagcttcctgatcatgtggcggaggccagaagaatgggggaaactcatctatcagtgggtttccaggagtgg

SEQ ID NO: 8648 - DNA, 491 bp, Homo sapiens
ccaggtttaaagccatcaacaagagatggtatagatctttcattgtctgagtttgagaagagaatcaattccttgttgatgaaatcattataagtcaaatgctttgttgcagtaccatataaaaattgctctggtaagccatgtagcctacgctgtctccggtcttccataaaatttgttaaccattcttttctgtcatcaatcttcttcttactaaatgccaaggtaatggcagcatcatcttcaggaccagcatatctaaacaagatgcgatgcctttccatatcagcaaaatattcctttgcttctttagctgtactagtacccaatcctttatagtactttattttccaggctttctggttttctatatgttttttccattcgtcaaattcaggaatactgtagaaggaaagttcctgcttatttttgcttgcctttacaataggagtaatgaactcttcaagaaaaccatgcttcaaaagtgatgg

SEQ ID NO: 8649 - DNA, 397 bp, Homo sapiens
ccactgtgtagcaccttctaattcaatttcatcggcagttgtaataacagttccagcctcaggtgttttaatggtgggaaacatcttgattgcttctccagaaacttgaccataggttttgttttggaaatcttggagaatctcagttccttccacagcaataagttctgtgggagaagcttccatttcttctaataactcaggtttaccatcatcttctgaaggttctaattttgtgtcaggagataaagagggaggctcagttatgtgaaggtattcctcacttgatggtttgaaagtcgcttcaatatttacatgaatttccttaaaagaatcctgtggggacattacagatgagccgacgtctattcctggcagagcactgggctgggggatc

SEQ ID NO: 8650 - DNA, 546 bp, Homo sapiens
  misc_feature (1)...(546): n = g, a, c or t
ctgggagagctagactaagttggtcatgatgcagaagctactcaaatgcagtcggcttgtcctggctcttgccctcatcctggttctggaatcctcagttcaaggttatcctacgcagagagccaggtaccaatgggtgcgctgcaatccagacagtaattctgcaaactgccttgaagaaaaaggaccaatgttcgaactacttccaggtgaatccaacaagatcccccgtctgaggactgacctttttccaaagacgagaatccaggacttgaatcgtatcttcccactttctgaggactactctggatcaggcttcggctccggctccggctctggatcaggatctgggagtggcttcctaacggaaatggaacaggattaccaactagtagacgaaagtgatgctttccatgacaaccttaggtctcttgacaggaatctgccctcanacagccaggacttgggtcaacatggattagaagaggattttatgttataaaagaggattttnccaccttgacaccaggcaatgtagttagcata

SEQ ID NO: 8651 - DNA, 386 bp, Homo sapiens
  misc_feature (1)...(386): n = g, a, c or t
catgatgcacaagctactcaaatgcagncggcttgtnctggctcttgccctcatcctggttctggaatcctcagttcaaggttatcctacncanagagccaggnaccaatgggtgcgctgcaatccanacagtaattctgcaaactgccttgaagaaaaaggaccaatgttcgaactacttncaggtgaatccaacaagatcccccgtctgaggactgacctttttccaaagacgagaatccaggacttgaatcgtntcttcccactttctgaggactactctggatcangcttnggctccggctccggctctggatcangatctgggagtggcttcctaacggaaatggaacaggattaccaactagtagacnaaantgatgctt

SEQ ID NO: 8652 - DNA, 488 bp, Homo sapiens
  misc_feature (1)...(488): n = g, a, c or t
ggttggggcataccttggttttatacattttagggagacataagacattaatcaatatatgtaagaagaacattggttcagtggggagggagcttccaggtcacagataggtgagacacaaacagttgcattcttttgagtttctgattagcctttccaaaggaggcaatcagatatgtatctatctcagtgagcanagagataactttgaatagagtgggaggtgggtttgccctaagaagtttccctaagcttgagttttccttagtgattctggggccccaagatattttcctgtcacagttgacatccccaacacagtgtttanggctcanaaaaagataccctaaaatagggtgctttggcatgctgaatgctttgaataaaggaggctgaagggcctcagnaaataagagaacaaaggtctgtctctgacccactgctgcccacctcccttcccttccaaagcacagggagggattttcttt

SEQ ID NO: 8653 - DNA, 493 bp, Homo sapiens
  misc_feature (1)...(493): n = g, a, c or t
ccatagaaagataactgctgtaagattcagtgttggtacattcacaccccattcttttttttttttttccccatcagtcaatcttatctggtaatgggatcattactgttatccagngccaatggtctcagtagtatttccattcaaaaataatttancttttanattaaggatttctctttttgttttattaaacattgaaaggtgggactttaaaaaatggtntaaatctanattttaaggattcttttnttacaaactgtctcagctttttacaanaaatgtttaaataccaaaatgctgctcanaaaatttaaagtttaattgcccgnggttattctactgtttctatcccaatgtgtgctcctctgtactgcgtgtgtaanacnctcagttcatctgaatgtttggatgggaagttttgtgttgagcctccaggcatagcactggaccagcccaggccgntgtggcaaaacgggagggganaatggga

SEQ ID NO: 8654 - DNA, 559 bp, Homo sapiens
  misc_feature (1)...(559): n = g, a, c or t
cctttaaaattccattatcttaggatgtttttaaatgattactttaaatgtgattatttcctaaaccacacaagagtaaaatagagcatttattgatggaataacaaaagtgcttttcttaaatattcttcaaaatacatttgtacaacttacaataatatatccaaaataactgtatatacaaaacattacctagttttaatgtatgtgcttttttccccaaaaattacaaagtaacttcttttttttttggcaaagttcaaccttaacagaggtgacaattttaaaggttggtttaagaaaatagaacctgagggaaattgacacgcaagagtcaatgacaagcaagagatttggaggaatatttttagtttgttaaattaaaaatgttttttagagtgatacttttcacattacaaaaataaaccaaaatgaagaaaaggtcactgtaaaatgatggaaaaaggatctgtagatttgcttttagtatttcaaatagccaacaatgcatgtcagaaaatgaatgcaagatcacaacagtcttgnatttactttgtat

SEQ ID NO: 8655 - DNA, 553 bp, Homo sapiens
  misc_feature (1)...(553): n = g, a, c or t
cttacatcattcttttaaaagtagtcttttattaagagtcaaaaattttatatttttgttttcgttggactaattctaaaatttaagttcctcttacggaatgttatcaaaaattatatagttatatgcttagaagtcttctattgattaagccatcaaacttaagtacatcaaaatttgtactttaaagtttaaattcttttttccttgtgaacataatcctataaactaaaattttcctggaccaagttatttttgtagtttactaatatacaattgatcaaaacaatataaagctatcgtaacatgtgaaagattatacaaattgtaaaaattttgttggaaatatgtcttaatgagatgattagggctgtttttcccaattcacatttccgtagggaaatattccttaaaactagaatgtggcatggcttancacatttcactctcattttgtttgatagatgtaaataccgagaaaatctgtttacataagtagatgaaaatgatagttttattgngcactgctactcaatttttaaaagcaatttct

SEQ ID NO: 8656 - DNA, 430 bp, Homo sapiens
  misc_feature (1)...(430): n = g, a, c or t
ccagcgacagcctggcctgggaatggactggcagctcatcactaaaatgactcctttcatggaatccactgttatgcagccacactgaccacagagcaactgaataggtgagcattggattgttgatgacaactcttcagcagaacaattgtgtgtttgaagggactgttttatgatgaaataactgttatttcctggagctaattgntgaatgacagtttgtcaactgtttaaatgaatttcatttgaattaacaattatacagccactcagaggtcctacattcgccagagttggcatccanttgatgggttcatttnaattaaatggtttggaggctaacgtgattttttaaattgaatttcatnactattctgngtattctatttatcactatnctaaatgactcatggntggntaattgattatc

SEQ ID NO: 8657 - DNA, 309 bp, Homo sapiens
  misc_feature (1)...(309): n = g, a, c or t
ctggaatccncagttnaaggttatcctacncagagagccagntaccaatgggtgcgctgcaatccagacagtaattctgcaaactgccttgaagaaaaaggaccaatgttcnaactacttccaggtgaatccaacaagatcccccgtntgaggactgaccttttnccaaagacgagaatccagnacttgaanacgtatcttcccactttctgaggactacntctggatcaggcttcngntncggctccggctctggatcangatctgggantggcttcctaacggnaatggaacaggattaccaactag

SEQ ID NO: 8658 - DNA, 555 bp, Homo sapiens
  misc_feature (1)...(555): n = g, a, c or t
ctggtattttgcctaagatctatttaagataaccttttcttatattttttacttaatattgggcataatcgtatcattcaagattaagtctgggctatttctttgataagaactgaatgtggccgggcgcagtggctcacgcctgtaatcccagcactttgggaggccgaggtgggtggatcacaaggtcaggagatcgagaccatcctggctaacacggtgaaaccctgtctctactaaaaatacaaaaaattagccgggcgtggtggcgggcgcccgtaatcccagctactcgggaggctgaggcaggagaatggcgtgaacccgggaggtggaggttgcagtgagccgagattgcgccactgcactccagcctgggcgacagagcgagactgtctcaaaaaaaaaaaaaaaaaaaaggaacggaatgtactggagatgtatttgataaccaangttttaggtaaattttcaccagtattagttctatttgcaaactgaaaaatgttgtaggcttaatataaaataaccacattagngaacattatatctctt

SEQ ID NO: 8659 - DNA, 508 bp, Homo sapiens
gaaaagcagcttctaatgagccaataaaaaatacaggatggcaatcaccatatcttgaagaaaactctgctgtaaattgtaataaggcatctccttcattttctgcgttttctggcactaaaaaacaaacaaaagaaaaaacaaaaacaaaaaaacaaaacaaatagacacaaaaacaaaccacataacatctaatcccacatataagaaatatattcaatcaataaagaggaaataaaattaaattttagcttctgtgatatatctgaggggatagtttaactcaacatatattagatctcatcaaaccagaatcaaaaagaaccttaaaatattccaagctcataaattttgaaaaaccaatggacacaatcctgctaagcatttaaaatatgtgcccagttgtcatttaggatttcaatgttttcttgaaatagacatcttgtgactaaattatattaaatgggtctgatattattttaaagacttcattaattggggaaaataa

SEQ ID NO: 8660 - DNA, 449 bp, Homo sapiens
ctgggagagctagactaagttggtcatgatgcagaagctactcaaatgcagtcggcttgtcctggctcttgccctcatcctggttctggaatcctcagttcaagaaagacgagaatccaggacttgaatcgtatcttcccactttctgaggactactctggatcaggcttcggctccggctccggctctggatcaggatctgggagtggcttcctaacggaaatggaacaggattaccaactagtagacgaaagtgatgctttccatgacaaccttaggtctcttgacaggaatctgccctcagacagccaggacttgggtcaacatggattagaagaggattttatgttataaaagaggattttcccaccttgacaccaggcaatgtagttagcatattttatgtaccatggttatatgattaatcttgggacaaagaattttataga

SEQ ID NO: 8661 - DNA, 95 bp, Homo sapiens
  misc_feature (1)...(95): n = g, a, c or t
actacttccaggtgaatccaacaagatcccccgtntgangactgacctttttccaaagacgagaatccaggacttgaatcgtatcttnccanttt

SEQ ID NO: 8662 - DNA, 600 bp, Homo sapiens
gttaggagttcctcatggacctcgaagatgtgtggttccccaggccattgagctccataaagagaaggttgtttgtattgctgctggactgaggcatgcagtagctgctacagcgagtggcatcgtgttccagtgggggactggtttggcatcatgtggacgacggttgtgccctgggcagactcttccattgtttttcacagcaaaggaaccaagcagagtgacaggtctagagaattctaaagcaatgtgtgttcttgctggctcagaccactcagcttcattaacagatgcaggagaggtgtatgtttggggaagcaacaagcatgggcaactggctaatgaggctgctttccttcctgtgccccagaaaatagaagcacattgtttccagaatgaaaaggtcactgccatctggagtggatggacacacctggttgctcagacagaaactggcaagatgtttacctggggccgagcagactatggtcagctagggaggaagttggagacttatgaaggctggaaactagaaaagcaagattcatttctcccctgttcaagaccaccgaacagcatgccttcatctccgcattgctt

SEQ ID NO: 8663 - DNA, 252 bp, Homo sapiens
  misc_feature (1)...(252): n = g, a, c or t
gtgagctgngactgngccatngcactccancctgggcaacaagagcaaaactccgnctnanaataaataaatnaataaataaataaataaataaataaataaatataaataaaagtagtgggttgatacggnccaatttatttgtnanagatcaccgtggctcttgggtagagaatggatttgaagctggcctaacctanaattggacagacaaaatgggaggctgttgcantaatctanatggtggatggt

SEQ ID NO: 8664 - DNA, 517 bp, Homo sapiens
  misc_feature (1)...(517): n = g, a, c or t
ccaatgggtgcgctgcaatccagacagtaattctgcaaactgccttgaagaaaaaggaccaatgttcgaactacttccaggtgaatccaacaagatcccccgtctgaggactgacctttttccaaagacgagaatccaggacttgaatcgtatcttcccactttctgaggactactctggatcaggcttcggctccggctccggctctggatcaggatctgggagtggcttcctaacggaaatggaacaggattaccaactagtagacgaaagtgatgctttccatgacaaccttaggtctcttgacaggaatttgccctcagacagccaggacttgggtcaacatggattagaagaggattttatgttataaaagaggattttcccaccttgacaccaggcaatgtagttagcatattttatgtaccatggttatatgattaatcttgggacaaagaattttatangaaatttttaaacatctgaaaaagaagcttaagttttatcatcctttttt

SEQ ID NO: 8665 - DNA, 565 bp, Homo sapiens
caaggttatcctacgcagagagccaggtaccaatgggtgcgctgcaatccagacagtaattctgcaaactgccttgaagaaaaaggaccaatgttcgaactacttccaggtgaatccaacaagatcccccgtctgaggactgacctttttccaaagacgagaatccaggacttgaatcgtatcttcccactttctgaggactactctggatcaggcttcggctccggctccggctctggatcaggatctgggagtggcttcctaacggaaatggaacaggattaccaactagtagacgaaagtgatgctttccatgacaaccttaggtctcttgacaggaatttgccctcagacagccaggacttgggtcaacatggattagaagaggattttatgttataaaagaggattttcccaccttgacaccaggcaatgtagttagcatattttatgtaccatggttatatgattaatcttgggacaaagaattttatagaaatttttaaacatctgaaaaagaagcttaagttttatcatccttttttttctcatgaattcttaaagg

SEQ ID NO: 8666 - DNA, 399 bp, Homo sapiens
agtgaccaggcagtttttctgcctttagctttgacagttcttaattaagatcattgaagaccagctttctcataaatttctctttttgaaaaaaagaaagcatttgtactaagctcctctgtaagacaacatcttaaatcttaaaagtgttgttatcatgactggtgagagaagaaaacattttgtttttattaaatggagcattatttacaaaaagccattgttgagaattagatcccacatcgtataaatatctattaaccattctaaataaagagaactccagtgttgctatgtgcaagatcctctcttggagcttttttgcatagcaattaaaggtgtgctatttgtcagtagccatttttttgcagtgatttgaagaccaaagttgttttacag

SEQ ID NO: 8667 - DNA, 327 bp, Homo sapiens
ccatgaactctatcaagtacagtaccctgttggagagtgagaaaaatactttcatggaaatctggaagaagagatgggataagttcatagcagatgtggctacaaagtgaggagaagctagccagccctctacaagctgtcttcttgcacacgctgtcacttcctctcactcgttcttgaatcagctccatgtgcccatgaaatcaatggcctctgtatggagcgaccctgtgagaagcacttggctggctgagcaaattcatcctctggaaatattctctctcagccacagtgacattgaccctcttggttttctcctctctctgg

SEQ ID NO: 8668 - DNA, 415 bp, Homo sapiens
ctgctggctctatcttctagataacattaacgacgtacggggaggagcccaggatagcaccataaactccctgcatgagatcaatagctatggtgtgccaccctgttcactggcacgctgtgctaaatgaagggcacgatgttcacagttccgtacccacgacttcgctttttccctaaagagcgatctcatgcctgcctagagtcctaaccactcgggaggctgaggtaggaggatcacccaagcccagaaggtcgaggctgcagtgaactgtgattacgccactgtgctccagccagggtgacaaagcgagaccccgtctctatttaaattaaaagaaaaaaaaaagtaactttaacttccattatttactctacccaatgcattatctacccattagggagacatctagttt

SEQ ID NO: 8669 - DNA, 449 bp, Homo sapiens; identical to SEQ ID NO: 8036

SEQ ID NO: 8670 - DNA, 530 bp, Homo sapiens
  misc_feature (1)...(530): n = g, a, c or t
accaaaaggttnacagacttggaattttgttccattatataactgagatcattatctaatccctgctctttacataaaactttatgtggttcattttatggtaaggcttnctacgaaataataaaacaatctttttctatagaatttgtggaactagtatttttattttcctgtcatgtcttgccttttctgacttctgtcatacacacaaacacacacacacacagagatacatgtgtatgtttgtttggcaacataggagggacaagcttagtttctcgtattctacgtgtcttataagatcatggtttgctatgtttacagatttatccccttctattagagtacccgaagttcttttaaaatatacaagatgttttcctactggtatgacatccctgaagtacttgtctttctttagttttattcttttagaacaagaaggaaaaaaaaacccgagaaataacctttaaagttttttaaaaattactttgtaagagatgtaagttgaatctcctctatataaagta

SEQ ID NO: 8671 - DNA, 500 bp, Homo sapiens
tctgaccatccatatccaatgttctcatttaaacattacccagcatcattgtttataatcagaaactctggtccttctgtctggtggcacttagagtcttttgtgccataatgcagcagtatggagggaggattttatggagaaatggggatagtcttcatgaccacaaataaataaaggaaaactaagctgcactgtgggttttgaaaaggttattatacttcttaacaattctttttttcagggacttttctagctgtatgactgttacttgaccttctttgaaaagcattcccaaaatgctctattttagatagtttaacattaaccaacataattttttttagatcgagtcagtataaatttctaagtcagcctctagtcgtggttcatctctttcacctgcattttatttggtgtttgtctgaagaaaggaaagaggaaagcaaatacgaattgtactatttgtaccaaatctttgggattcattggcaaataat

SEQ ID NO: 8672 - DNA, 509 bp, Homo sapiens
ctgcactgctggatgcttgcctggttcccagcctttaaggtttttagtctataagttcaacgttgttggaaaagtgctctgatacctgcagaggtgggagaaaggtgggggcagtcctctgctaggagatggaagggacaatcaaagcttagtagcttgagctggtcctggaagagcaagtaggagctctttagccagactaagagaagggcattcttggcagaaggaatattctatataaagaagtggagtcagggaacagtagggctctttgaagaactacagattgtgttctaaatgaatgacatgtaaggtttgtaaggggcgagtgataaccactgatgaatggcagatggtgttgacaactaggcggggccagagtctgtaggatcttacatgtcttgcaatcagttttgactttgaccttggaacccagttgaggctcccttccgccccagttcctcatggcagggaaatacatcatgttgtgcgttgtaagacttcaaaac

SEQ ID NO: 8673 - DNA, 331 bp, Homo sapiens
  misc_feature (1)...(331): n = g, a, c or t
aatcaanatntaatttttttatttgtactgaaanactaatcataactgttaattctcagccatntttgaagcttgaaagaagagtctttggtattttgnnaacgttagcagactttcctgccagtgtcagaaaatcctatttatgaatcctgtcggtattccttggtatntgaaaaaaataccaaatagtaccatacatgagttatttctaagtttgaaaagtaaaaagaaattgcatcacactaattacaaantacaagttctggaaaaaatattnttcttcattttaaaactttttaactaataatggctttgaaagaagaggcttaat

SEQ ID NO: 8674 - DNA, 243 bp, Homo sapiens
cccaaccagattcctcatagagattcctaatcactagtttcttgtattcataaactcagagatacagagggcttggtttgaagttggggtgagatgaaacctttgctctgagccaaagctctggggccttgcattccctgcattgggttgatgactgtcagcatcactgccgcaggccatgcttgactaaggtacctggttttagccacagccacctccttgtatgttacctttcagctctgg

SEQ ID NO: 8675 - DNA, 497 bp, Homo sapiens
  misc_feature (1)...(497): n = g, a, c or t
ccaagcctcancctttggtccantgcancccttgcctngcttgncaacagtgaaaaattagtttggttagaagaaccatctggaaacacaccancttctgctaccttcatgctcattgttaaaaaaagattaaccagtgtgaacattctgatctgttaattccagggactgttttctttccaatggactgttngttggtagaataacccccaaaagctcaaagctaaaatgcatcatcantcctagtnggcagntccttaagaatggactggcggcgtggttganctgatatggaaaanctgcaccttcctgcagaagatcaactgacctgctatcccaccccaaatttcagcctgaggtatatttcagtgaaggcaggtagctgtgcttctcagagcagagaagcngttttaagagcaaaaaggtagaggaaatctagaaaagaaccgtcttgatacagatttatcccatggtgtgaagggagggcaaagaaccca

SEQ ID NO: 8676 - DNA, 540 bp, Homo sapiens
  misc_feature (1)...(540): n = g, a, c or t
gaaaagaaaaagacttaaattannacttgtngaaatgagtattacaatgactgaaatgaaaagtacactggatagggtgctgtggttcangcctgtantctcancnctttggaaggntgaggcgggcagatcccctgagtttgggagtttgagaccancctgaccaacatnngaganaccccatctctactgaaaatacaaaattacccgggtgtggtggcancatgcctgtaatctcagctactcgggaggctgaggcanaagaattgcttgaatctgggaggcggaggttgtggtgagccaagatcntgccattgcactccancctgggcaacaagagcgaaactncgtctcaaaaaattaantaaataaggcttatgtgcagntattctcaatgagctaaaaagcttcctgaggctagaaattcttgtcatttttggctgggagcagnggcttacacctgtagtttcagcattttgggaggtcgaggcgggcagatcacctgaggtcagggatttgagaccagcctgnacctnggcc

SEQ ID NO: 8677 - DNA, 406 bp, Homo sapiens
ccaattgaaacaaacagttctgagaccgttcttccaccactgattaagagtggggtggcaggtattagggataatattcatttagccttctgagctttctgggcagacttggtgaccttgccagctccagcagccttcttgtccactgctttgatgacacccaccgcaactgtctgtctcatatcacgaacagcaaagcgacccaaaggtggatagtctgagaagctctcaacacacatgggcttgccaggaaccatatcaacaatggcagcatcaccagacttcaagaatttagggccatcttccagctttttaccagaacggcgatcaatcttttccttcagctcagcaaacttgcatgcaatgtgagccgtgtggcaatccaatacaggggcatagccggcgc

SEQ ID NO: 8678 - DNA, 388 bp, Homo sapiens
  misc_feature (1)...(388): n = g, a, c or t
ctgcttcaggggaaggcttgtggcttatatctattttgttgtattcctntagttcaacatgtctgcccccacccttacttctaacacctctgcccactccagtattccctcagaacctagcctggtaacgaatatatggacaattaaattacatcccaacatcattcatactttaatatataagaaatcagagcagagaatcagggcagccagtccctgaaggaagagtctgtgacaaatcacaagtatgatcacagcacgaacttttctattctagcctggcctctangaagaaaacagagagtgttaccggacttaaggggaaaaaggacatgcttgatgaaggacagaaccccattgttctccacatttcctggctcacagaagg

SEQ ID NO: 8679 - DNA, 562 bp, Homo sapiens
  misc_feature (1)...(562): n = g, a, c or t
ccaatgaacacattacgtcctctgtatggtttttatcaagtaactgccccagtgctcccatgacgctgggcaggtccacttgttaggccagtgagggccatagttcgttggtaattaagtgttaacattgttacactcctttttatggttactggtgatctgatttccagaacaatttgttcactccagattatgatgatggcttttcaatgaagcatacagccaccgcccgtttccagagaaaccaccgcctcatcagtgaaattcttagtgagagtgtggtgccagacgttcggtcagttgtcacaacagctagaatgcaggtcctcaaacggcaggtccagtccttaatggttcatcaggtaaagtcataaaacattcatttcaataagatgtgcctataccacaaatcccaggtgatatgattcctacaccatgcctaaatctacctgttaaatatgtcaatctaacctgttcctgatttggagaagaggtttaaggaagtggacctttcccanatgtttaataagtttgncattaaaaactataatatagaaccttg

SEQ ID NO: 8680 - DNA, 345 bp, Homo sapiens
ccatcacagggactcacatgggagccttttaaaactccagatggtggctgagcacagtgattcatgcctgtcatcccagcactttgggaggccgaggccggtggatcacttgaggccaggagttcgagaccctcctgggcaacatggtgaacccgtctctactaaaaatacaaaaattagctgggtatggtgatacgcgcctgtaatcccagctactcaggaggctgaggcgggagaatcgcttgaacccgggaggcggaggctgcagtgagccagattgtaccacttcactccagcttgggcaacagagcaagactctgtcttggaaaaaaaaaatacagatgg

SEQ ID NO: 8681 - DNA, 562 bp, Homo sapiens
ctgggcttcattggtaagatgttcaagtcgctggacctgagcctgattgtagagttcattctcatgttctaccgggacaagcccatcgactggctcctggaccatattctgtgggtgaaagtctgcaaccccgagaaggatgcgaagcactgtgaccggcagaaagccaacctgcggatccgcttcaaaccgtccctcttccagcacgtgggcactcactcctcgctggctggcaagatccagaaactgaaggacaaagactttggaaagcaggcgctgcggaaggagcatgtgaacccgccagcagaggtgagcacgagcctgaagacataccaccacttcaccctggagaaagcctacctgcgcgaggacttcttctgggccttcacccctgccgcgggggacttcatccgcttccgcttcttccaacctctaagactggagcggttcttcttccgcagtgggaacatcgagcacccggaggacaagctcttcaacacgtctgtggaggtgctgcccttcgacaaccctcagtcagacaaggaggccctgcaggagggcc

SEQ ID NO: 8682 - DNA, 570 bp, Homo sapiens
  misc_feature (1)...(570): n = g, a, c or t
ctgaagggtacagccatttcatagggtcctctcagagagtatttggtttgctttcctaactttctaaaaatagtagattacacaggccacctccatctcatggctcaagaactcagaaaaggctggactatggatttaagcaatacacaggacacattttattaaagaagtcaggattattacaagttttctaaatttttttccgtttactctgtgagagaatgcaaatgatctagcggttaatggcatggaaacctcataacgctcccaaatttcagaacttcaagcatgagtcatacagttactttaacagttttaaaatatgtttttgatctattttagccacaagactgaatacaagaggactgctatctgaagggaaggattctaaatactgtacaaagaatcacatgtgtcagttataaatatatacacacacacgtaagaaacatgttttttaacataaatgcttaattacatattcaaaattgttttaatgcttaacataattattttactaacatttaanaagctactgtcctgggtatgaagctccatcataaataaatt

SEQ ID NO: 8683 - DNA, 454 bp, Homo sapiens
ccactaatgtgccatcttgagttggaaaacaagccccctccccccaaaaaaaaccctgccgctttggtgtcctatttatatatttttaaaaacattcattaaaaaaatcaaatctataataaaaatgtccctgtttgttttaaaaaagcattagtaggcatcccttatctactaaaaccatttgtttttcctaagatgcctggaagcagaaaagcgagtgagattaactcactgcgcaattaattaaaattagaattctttcctctaaacaacttccagagcaccagaaagaagaaggggccccatcaaagggagaaataaagcccttctgactcacaggagatgaaatgttcagccagagttctaacacattctggctgtcatcaaaagttctttattggattactcagaaaataactcaagtgctattttaaaaatgaaagatacaggcagc

SEQ ID NO: 8684 - DNA, 574 bp, Homo sapiens
  misc_feature (1)...(574): n = g, a, c or t
ccaaaaaaatcaagatttaatttttttatttgtactgaaaaactaatcataactgttaattctcagccatctttgaagcttgaaagaagagtctttggtattttgtaaacgttagcagactttcctgccagtgtcagaaaatcctatttatgaatcctgtcggtattccttggtatctgaaaaaaataccaaatagtaccatacatganttatttntaagtttgaaaagtaaaaagaaattgcatcacactaattacaaaatacaagtnctggaaaaaatatttttcttcattttaaaactttttaactaataatggctttgaaagaagaggcttaatttgggggtggnaactaaaatcaaaagaaatgattgacttgaaggtctctgtttggtaagaatacatcattagcttaaataagcannanaaggttagttttaattatgtagcttctgttaatattaagtgttttttgtctgttttacctcaatttgaacagataagtttnnctgcatgctggacatgcctcanaacncatgaatagcccggtactanatcttgggaacatggatctt

SEQ ID NO: 8685 - DNA, 592 bp, Homo sapiens
  misc_feature (1)...(592): n = g, a, c or t
gccagatgcaatacaagattcctggttaaatttgaatttcagtaaacaatgaatagtttttcattgtaccatgaaatatccagaacatacttatatgtaaagtattatttatttgaatctacaaaaaacaacaaataatttttaaatataaggattttcctagatattgcacgggagaatatacaaatagcaaaattgaggccaagggccaagagaatatccgaactttaatttcaggaattgaatgggtttgctagaatgtgatatttgaagcatcacataaaaatgatgggacaataaattttgccataaagtcaaatttagctggaaatcctggatttttttctgttaaatctggcaaccctagtctgctagccaggatccacaagtccttgttccactgtgccttggtttctcctttatttctaagtggaaaaagtattagccaccatcttacctcacagtgatgttgtgaggacatgtggaagcactttaagttttttcatcataacataaattattttcaagtgtaacttattaacctatttattatttatgnatttatttaagcatcaaatatttgtgcaagaat

SEQ ID NO: 8686 - DNA, 348 bp, Homo sapiens
tgaaggtcagggggtgctttgaccattccaaggagctgtatatgatgccccggaccatggtggaccctgtccgggaggcccgggagggcggcctcatctccttctcaactcagagtggggcctatgtggtcactcccttccactgcaccgacctgggagtcaccatcctggtaaatagagggttcgttcccaggaagaaagtgaatcctgaaacccggcagaaaggccagattgagggagaagtggacctcattgggatggtgaggttgacagaaaccaggcagccttttgtccctgagaacaatccagaaaggaaccactggcattatcgagacctggaagctatgg

SEQ ID NO: 8687 - DNA, 580 bp, Homo sapiens
  misc_feature (1)...(580): n = g, a, c or t
ataaagggaagttaaaagccagcagttccagtcagccatcaagctctgaaagtggctcatttctcctcaaatctggcacaacacccctgccacctggagcagccacttctccctccaagagcacaaatggagctcccggtactgttgttgaatcagaagaagaaaaagccaaaaaattactttattgttcactatgcaaagtggctgtgaactccctgtcacagctagaggcacacaacacaggttagcagctatcttttgcatttaaataatgtttataacaaaacccaacttttcccatcagaataccatatcttttgttgttcagaccttaggtttgttccatgcttntctacttttttgattcaaaggagtgattttagaaaagtatgatcatatgactttggaactagcaagacaaaagcagtttggagatcaaacttgttctattctttattttcttaaaaacatctaatactgtccaaaactcattttgatgaagtgacaaagatgaagataaatatttatgcacagtgttcactgcaatacacttaaaagagaaaaaaaatggaaacaacct

SEQ ID NO: 8688 - DNA, 300 bp, Homo sapiens
  misc_feature (1)...(300): n = g, a, c or t
ctgggactacaggcacctgccaccatgcctggctaaatttttgtattnntagtaganacagggtttcacnagtgttaaccaggatagnntcaatctnctgacctcatgatccgtctgctntggcctncnaaagtgctgcaattacaggcgtgagccactgcgnccagcccaaagtggttaatattaatatgctgagtacctnncatgtgccanacacataagatactgnatgttnctatttcatcaatggagaaacagaagtctgagtggggtnaaagaacgggctncccaatgtcacac

SEQ ID NO: 8689 - DNA, 485 bp, Homo sapiens
  misc_feature (1)...(485): n = g, a, c or t
cgccgcttgtgctgcanccatgtctctagtgatccctgaaaagttccaacatattttgcgagtactcaacaccaacatcgatgggcggcggaaaatancctttgccatcactgccattaagggtgtgggccgaanatatgctcatgtggngttgaggaaagcanacattgacctcaccaagagggcggganaactcactgaggatgaggtggaacgtgtgatcaccattatgcanaatccacgccagtacaagatcccagactggttcttgaacagacagaaggatgtaaaggatggaaaatacagccaggtcctagccaatggtctggacaacaagctccgtgaagacctggagcgactgaagaagattcgggcccatanagggctgcgtcacttctggggccttcgtgtccnaggccagcacaccaagaccactggccgccgtggccgnaccgtgggtgtgtccaanaagaaataagtctgta

SEQ ID NO: 8690 - DNA, 584 bp, Homo sapiens
cctgccctgtgacactcaatcacagttgacgtcaggatgggtacaatgtctgcaagagaaaaggggagagcagcaacagcacagtgtctgctgtcctcagtgatacaggcgggattccaccctggttctgtaggaaaacagggtcatggtctctgaactttgctttttctgcaaagaaccagatatgatctgtttaatgaggaaagtacgtagctgtggggtcaggctaactgcccatcaagtgcttttcctttgatgacaccatgttctgccttgtaacactaggacctgcaccccttgaggcaacacttccatgagtttcctttcatgcctcttagatattttttgcatctgacaggactgctgataaaagcattagggggattaatgactttatacactaatctctctgcaggcatcaaattctttcttcaggacagacacccagaattactggctcaaaaacaggaccttttaaaaaatactcttaccacaaattgccaaactgctttctgcaaaggccataccaatttccatccccaccagcagtcatgagagtgcctgtcctatcccataccttgccc

SEQ ID NO: 8691 - DNA, 641 bp, Homo sapiens
  misc_feature (1)...(641): n = g, a, c or t
ctgcacactgtatcattttcatttctctcccttgctgtcccctctgcctctgtccttgcctcccatcatatggacacactgtgcctgacacacacgctcacataatctctccctttttgtttccctagctactcatcaacctcaggtttgcaggaaaaaaacataagatgaaaagagaaaattgtgtgacagcaccataaataaaattaaagcgatataaaatgtgtaacagagaatgcacaatcaaaataacctaatattcagtgatactccattaacataaatagaccgtctcaaaactcaaagatgccaagtatctcagcaagatttactctctttagacgtaactcatgacaaggcactgggtaaaaactgtaatttgtgaatgccaaataatgacaaataacaaagtaaaatatgctaggtgcaaaaacactcttagtactgaatgaattgacaaagacaccctttatttcaataaccagccaggagaaccttccagccacggtgaagatacgaacgctcagcgagcaaacggtacttactgtgtgctgtggtccaagtaagtgattactctgtctccctcttccnntaagcgtttactnacatggttaagatattctggaaccttacaaacaaaa

SEQ ID NO: 8692 - DNA, 70 bp, Homo sapiens
  misc_feature (1)...(70): n = g, a, c or t
tcaggaanatcactngaccacnnaagatgaaagctgcagngagctanctntgattgcaccantgnacgcc

SEQ ID NO: 8693 - DNA, 359 bp, Homo sapiens
  misc_feature (1)...(359): n = g, a, c or t
taactatcacccttgtagatattacactaaattaaaacaatagtgatacaaattcccaccttaccaaaatagcaataatccaatttatttcctagtttatttaatcagattctcctaccaaccatctcctcttctattttttaaatcaattaaaataaaggcaagagaaaagctctagttttatgtatttcaaccatagcttggatgttatgttttcccttttcctatatacaaaaataanatttgctcacatctgcacttttggtttagaaaatacatctggcaatcttcagtgatagtgaaaataagaatgctaagatactagagaaccacacctaagcaccctttttgaaagcagg

SEQ ID NO: 8694 - DNA, 590 bp, Homo sapiens
  misc_feature (1)...(590): n = g, a, c or t
ccatatttattcattttccacacacttgaccatctactttgtataacacattctgctaaggcccagggatacaatggcaaacaagatagatgtagttccttcccttgtggcatgtcataagagaaacagatgtgcatatacacacaataaataagaaaattaataattgtattaagtggtatgaaaaaaagggggaggattgttcactcactgttacctgtgttagtatctgcaaatgcatgaatggttgaactcccatgtcagcatttttgttgccatttatttagtaccagacatagtgctggtctcacagcttaatatttggtaatgaataaattctgctagtggtatatgttgatctgaacttacaatgatgggatatagaattggcagagtggcagatgttcacaattgtctacaagtagatgtgctagacaatggaaggatgcaggccaacctctttgattacaattgagattcatgtgactattgagccctggaaatgtagcttgtccaaattgagatgtgctgtcagtataaaatacataccagattttaaagatgtnccaaaaaatgtaaactatctcaat

SEQ ID NO: 8695 - DNA, 536 bp, Homo sapiens
  misc_feature (1)...(536): n = g, a, c or t
gcatcccatgtgcntcgatgggcaaagtatttgtagcactgcccttggaatttgtgccagccatagtcacatgtctcggtatcttgctcacaaagtgcaccaacataacttggaaggcagaggcacctgaatgtgttaaaaccatcaacacaagtggctccattacgacagggattagagtgacattcatcaaaatcaagttcacactggtctccgctgnatcctggcacacaggtgcatacgtaggaagtttcagtaggataacaggtgcctccgttaaggcacgggttcattttgcagcgatcaggtcctggtaaatagattgccgtgccttccactgactcttcattaatgccaatcaggaaatctgtttcattagaagtctccagaagggaaaatggtggtgttgcaacctcagtattaaattccacagggtttactgntgcctgatcattggaatcaagaattctcgctgccacttgctgntctgatgctgctatcgtggaatcctgccctctgattaaagctgcttgagt

SEQ ID NO: 8696 - DNA, 595 bp, Homo sapiens
  misc_feature (1)...(595): n = g, a, c or t
cttttcttcctccaagtgaaggaaggaatccttagcgatgagatctactgcccccctgagactgccgtgctcttggggtcctacgctgtgcaggccaagtttggggactacaacaangaagtgcacaagtctgggtacctcanctctgagcggctgatccctcaaagagtgatggaccagcacaaacttaccagggaccagtgggaggaccggatccaggtgtggcatgcggaacaccgtgggatgctcaaagataatgctatgttggaatacctgaagattgctcaggacctggaaatgtatggaatcaactatttcgagataaaaaacaanaaaggaacanacctttggcttggagttgatgcccttggactgaatatttatgagaaagatgataagttaaccccaaagattggctttccttggagtgaaatcaggaacatctctttcaatgacaaaaagcttgtcattaaacccatcgacaagaangcacctgactttgtgttttatgccccacgtctganaatcaacaagcggatcctgcagctctgcatgggcaaccatgagttgtatatgcgccgcaggaagcctgaca

SEQ ID NO: 8697 - DNA, 234 bp, Homo sapiens
  misc_feature (1)...(234): n = g, a, c or t
cttgcncaaatattngatgcttaantaaatacataaataataaatanngttaatangttacacttgaaaataatttatgttatgatgaaaaaacttaaagtgcttncacatgtcctcacaacatcantgngaggtaagatggtggctaatactttttccacttagaaataaaggagaanccaaggcacagnggaacaaggacttgtggatcctggctancagactatggttgcc

SEQ ID NO: 8698 - DNA, 447 bp, Homo sapiens
ccacgtgacccccacctttctgagccaaagcacttaaaacacataataaacattcaaaaccatagcacttagaatcaggaagtccttttatcgtttttcacagtataaggcacttattttttgatatcattctctttttttaaaggcaaaggaattacaagtgaacacactagtcatggcccatcagaatgatagatgcttatctacaaaaacatttcctgacttcttgctgaacctcttgcctctgggaaatactgctgtttgcttacttaaaaagtggtgagaaattaatatgattctctcttcccttttaaaaaattaaatttgtataaatataaggcgtacaagtgcagttttgttacacggatatattgcgaagtggtgaagtccaggcttttcctgcaaccaacaccagaaaagtgtacactgtacccatcaggtactttc

SEQ ID NO: 8699 - DNA, 104 bp, Homo sapiens
  misc_feature (1)...(104): n = g, a, c or t
ctgtggactccancatgtttctgataattatgcnngcaacanttntgtancctcaagtaanaccacctgtgaactngannattatctggnccaaatatgaagat

SEQ ID NO: 8700 - DNA, 622 bp, Homo sapiens
  misc_feature (1)...(622): n = g, a, c or t
tccttttatattcccagaagtgggtttgctggatcatatggtaattctatttttagttttttgaggaacctctataccattttccatggtggctgtactaatttacattcccagcaacggtgtagaagagttcacttttctctgcattgttgctaacactgatctttcatctatttgagaaaatgcattctagcaggtgtgaggtaatctcattgtggttttaatttgcatttccctaatggctagtgctgctgaacgttgtttgcatgaacctggtatgtcttcttttgagaagcattttcacaagccattggtgaagtatgtggctcaccaccacccatactccagccctgttcccagtcactggtacctagagggtgagagtgaggctgctcatcaacgtgttctccaagtcataagctgctgctctcccactcacgatgcttggtgattcagtgatgttttccacttaaagacagtgatagctgtatcaccacagttaatagatgtctgatgtgtcccagtcacagagataatacaaatgtgaggaaatnatgctggtgcctgaaagcattggagaccatttgtaagaatgccatttggtagttaaagtgaacatgaa

SEQ ID NO: 8701 - DNA, 470 bp, Homo sapiens
ctgccccatacctggcaggatccagagggtgggccctgatggacaccagtctatcaggtcctccctgcaagatgctacagagtccttctccctcaacacatgtttggtgagcttggcacctacatgacacccggcttggagcactcgctgttcgtttcaaagtaactctccaggagtgaacacgggatgcttcgtggggtgtaggagatgcagcagtcagcactagtagcatggaatcctgcagcatgagaaagggtcatctgaggaccaatctttctcctccagagcatgtccagaagtactggattttccaatggaagctttgacatcatgaactctgtctctgcatcttttgtgacccgggcctgggatccaagggcagtaacaagcatgaggcaggagagggcagccacggagaccttcatcctcctggtgggcaggcagggctggccgaggactcctgggctcac

SEQ ID NO: 8702 - DNA, 547 bp, Homo sapiens
  misc_feature (1)...(547): n = g, a, c or t
gcaccctccgnttcctntcctaggcgacgagacccagtggctanaagttcaccatgtctattctcaagatccatgccagggagatctttgactctcgcgggaatcccactgttgaggttgatctcttcacctcaaaaggtctcttcagagctgctgtgcccagtggtgcttcaactggnatctatgaggccctagagctccgggacaatgataagactcgctatatggggaagggtgtctcaaaggctgttgagcacatcaataaaactattgcgcctgccctggttagcaagaaactgaacgtcacagaacaagagaagattgacaaactgatgatcgagatggatggaacagaaaataaatctaagtttggtgcgaacgccattctgggggtgtcccttgccgtctgcaaagctggtgccgttgagaagggggtccccctgtaccgccacatcnctgacttggctggcaactctgaagtcatcctgccagtcccngcgttcaatgtcatcaatggcggttctcatgctggcaacaagctggacct

SEQ ID NO: 8703 - DNA, 639 bp, Homo sapiens
ctgtctgtactagacaaggttaccaagtgcggaattggttaatactaacagagagatttgctccattctctttggaataacaggacatgctgtatagatacaggcagtaggtttgctctgtacccatgtgtacagcctacccatgcagggactgggattcgaggacttccaggcgcatagggtagaaccaaatgatagggtaggagcatgtgttctttagggccttgtaaggctgtttccttttgcatctggaactgactatataattgtcttcaatgaagactaattcaattttgcatatagaggagccaaagagagatttcagctctgtatttgtggtatcagtttggaaaaaaaaaatctgatactccatttgattattgtaaatatttgatcttgaatcacttgacagtgtttgtttgaattgtgtttgttttttcctttgatgggcttaaaagaaattatccaaagggagaaagagcagtatgccacttcttaaaacagaacaaaacaaaaaaagaaaattgtgctcttttctaatccaaagggtatatttgcagcatgcttgactttaccaattctgatgacatctttacggacactattatcactaagaccttgttatggcgaagtctttag

SEQ ID NO: 8704 - DNA, 586 bp, Homo sapiens
  misc_feature (1)...(586): n = g, a, c or t
caactgancgagtatctagatgccatgatgaatgaggctccaggccccatcaatttcaccatgttcctcaccatgtttggtgagaagttaaatggcacagatcctgaagatgtcatcagaaatgcctttgcttgctttgatgaagaagcaactggcaccatacaggaagattacttgagagagctgctgacaaccatgggggatcggtttacagatgaggaagtggatgagctgtacagagaagcacctattgataaaaaggggaatttcaattacatcgagttcacacgcatcctgaaacatggagccaaagacaaagatgactgaaataacttcaaattccagccaaacgttccttgttgccactttgggtattctgagattttctcttgcatgcccttagctttacagcttttgcatttcctgttgtatttattctcagccattttgggcatatgtatctttataatcagactggaaacgggactttctattaatatcattttcagaataaaaaataggataatttaacctaccagcccttctccnccaataactgnggnctatacagagtcaatatattttt

SEQ ID NO: 8705 - DNA, 386 bp, Homo sapiens
  misc_feature (1)...(386): n = g, a, c or t
cctatagaatagtgctcaagtatacggtntgctctnaaaaaaatgttagctgtggtttttattgtcttattataattagtaattctttcaaattaataatataagcttttacacacatatcataaaagttattaaaattattagagatattttgagtagtgacgctgaagaaagtaaaagtggaattcctaagtcatacttgaaagtatcaattatatttatagaagatcagtcctactttcaaccaccaagccagcaagaattgaaaaccaactggtcaacatatgtcgatgcagatggaaaaaggatacaactgtctttaaattccctaaagaaagctgagtggagagccttctggtcactgcagtccaacctatcattacgcg

SEQ ID NO: 8706 - DNA, 473 bp, Homo sapiens
ccagtggaatgatgttccctgcaattaccatctcacctatacgtgcaagaaaggaacagttgcttgcggccagccccctgttgtagaaaatgccaagacctttggaaagatgaaacctcgttatgaaatcaactccctgattagataccactgcaaagatggtttcattcaacgtcaccttccaactatccggtgcttaggaaatggaagatgggctatacctaaaattacctgcatgaacccatctgcataccaaaggacttattctatgaaatactttaaaaattcctcatcagcaaaggacaattcaataaatacatccaaacatgatcatcgttggagccggaggtggcaggagtcgaggcgctgatccctaaaatggcgaacatgtgttttcatcatttcagccaaagtcctaacttcctgtgcctttcctatcacctcgagaagtaattatcagttggtttggattt

SEQ ID NO: 8707 - DNA, 402 bp, Homo sapiens
ccaggctggtctcaaactcctggcctctagtgatctgcctgcctcggtctcccaaagtgggattacaggcatgaaccaccacgtccagccagtcattttcttaagtaggttcttcccagcctgcaaacccagtgaaagggcttattctttccccattactgtggggaaaaagtcctgtagaggctttccataggccctgtgtgactcacgtgtctatacctgaatcaactgttacaaccaagcagatgcagagactgcgtgccctctcctggagctaggagctaggtgagtcaatcctgcactttctctacaaggcttgcaaaggtgagcaagaagattccccaaagtgaaatcagggtgctgttaccaaaagaagctatgctggcaggcaaaaaacaacag

SEQ ID NO: 8708 - DNA, 481 bp, Homo sapiens
  misc_feature (1)...(481): n = g, a, c or t
tgaggactgacctttttncaaagacgagaatccaggacttgaatcgtatcttcccactttctgaggactactctggatcaggcttnggctccngctccggctctggatcaggatctgggagtggcttcctaacggaaatggnacaggattaccaactagtngacnaaagtgangctttncatgacaaccttangnctcttgacaggaatctgncctcanacagccaggacttgggtcaacatggattanaanaggatnttatgttataaaanaggattttcccaccttganaccaggcantgtagntagcatattttatgtaccatggttatatgattaatnttgggacaaannattttatagaaatttttaaacatctgaaaaagaagcttaagttttatcatncttttttttctcatgaattcttaaaggattatgctttaatgctgttatntatcttattgttcttgaaaatacctgc

SEQ ID NO: 8709 - DNA, 589 bp, Homo sapiens
  misc_feature (1)...(589): n = g, a, c or t
cctggccaacaacaccgttattgctaaagtaaataatgttgtgtgggacctggaccgccctctggaagaagattgtaccttggagcttctcaagtttgaggatgaggaagctcaggcagtgtattggcactctagtgctcacataatgggtgaagccatggaaagagtctatggtggatgttnatgctacggnncgccantagaaaatggatnctattatgacatgtacctcnaagaagggggtgngnctagcaatgatttctcntctctggaggctttgngtaagaanatcattaaagaaaaacaagcttttgaaagactggaagttaanaaagaaactttactggcaatgtttaagtacaacaagttcaaatgccngatnttgnatgaaaangngaatactccnactaccacagtctatagatgtggccctttgatanatctgtgncgggatcctnatgtnagacacacgggcaaaattaaggctttaaaaatacacaaaaattcctccacgtactgggaaggcaaagcagatatggagactctccagagaatttatggcatttcattcccagatcctaaaatgttg

SEQ ID NO: 8710 - DNA, 567 bp, Homo sapiens
  misc_feature (1)...(567): n = g, a, c or t
tgggagagctagactaagttggtcatgatgcagaagctactcaaatgcagtcggcttgtcctggctcttgccctcatcctggttctggaatcctcagttcaaggttatcctacgcagagagccaggtaccaatgggtgcgctgcaatccagacagtaattctgcaaactgccttgaagaaaaaggaccaatgttcgaactacttccaggtgaatccaacaagatcccccgtctgaggactgacctttttccaaagacgagaatccaggacttgaatcgtatcttcccactttctgaggactactctggatcaggcttcggctccggctccggctctggatcaggatctgggagtggcttcctaacggaaatggaacaggattaccaactagtagacgaaagtgatgctttccatgacaaccttaggtctcttgacaggaatctgccctcagacagccaggacttgggtcaacatggattagaagaggattttatgttataaaagaggattttcccaccttgacaccaggcaatgtagttagcatattttatgtaccatggnnatatg

SEQ ID NO: 8711 - DNA, 279 bp, Homo sapiens
  misc_feature (1)...(279): n = g, a, c or t
gggcattggtgtagacaacaggaaagtccaggctatagccgnactcaaaaacctttctgttccctttctgccagccctagggattgagtccacattcagcacangactctctgggtacagctctctttaggaagacacaaattgcatggtgaagtcagttatatcctggccgcctttggtccctcccaggaagacgggcatgttttctgcttgagaggtgctgatgtaccagttggggaactgggcagactcaaattccagctngttattgatttctat

SEQ ID NO: 8712 - DNA, 477 bp, Homo sapiens
gcgcctataatcccagctactggggaggctgaggcaggagaatcacttgaacccgggggacagaggttgtagtgagccaagatcgcaccactgcactccagcctgggtcacagagtgagactccatctcaaaaaaaaaaagagagagagagagaaagaaatagaagagaagagccatcttggcagggttattttatatctgagcaaggagtttaaatgagactagtttagattgtctgctgatgcagccgtccatagcagtacccctaaaatcccaccagaatacgggtccctctaacccagtggctggaagaaccactgtctagagcaacttttcttggaactgtcccagctaccaagtcagacaccaaggtttatgccaccaggtaacacgggaatcacaggtacatgtcgctccggtcagattagttggctttggcccctcgaccctgtgcaggagctagttctcagcttgcag

SEQ ID NO: 8713 - DNA, 494 bp, Homo sapiens
ccttatttctcttgtcctttcgtacagggaggaatttgaagtagatagaaaccgacctggattactccggtctgaactcagatcacgtaggactttaatcgttgaacaaacgaacctttaatagcggctgcaccattgggatgtcctgatccaacatcgaggtcgtaaaccctattgttgatatggactctagaataggattgcgctgttatccctagggtaacttgttccgttggtcaagttattggatcaattgagtatagtagttcgctttgactggtgaagtcttagcatgtactgctcggaggttgggttctgctccgaggtcgccccaaccgaaatttttaatgcaggtttggtagtttaggacctgtgggtttgttaggtactgtttgcattaataaattaaagctccatagggtcttctcgtcttgctgtgttatgcccgcctcttcacgggcaggtcaatttcactggttaaaagtaagagacag

SEQ ID NO: 8714 - DNA, 605 bp, Homo sapiens
ccagcgacagcctggcctgggaatggactggcagctcatcactaaaatgactcctttcatggaatccactgttatgcagccacactgaccacagagcaactgaataggtgagcattggattgttgatgacaactcttcagcagaacaattgtgtgtttgaagggactgttttatgatgaaataactgttatttcctggagctaattgttgaatgacagtttgtcaactgtttaaatgaatttcatttgaattaacaattatacagccactcaggggtcctacattcgccagagttggcatccagttgatgggttcatttgaattaaatggtttggaggctaacgtgattttttaaattgaatttcatcactattctgtgtattctatttatcactattctaaatgactcatggttggctaattgattatcatgtaagcaagctatttgaagaaattgattacatatatttatatatagggggtaactaattaatgattacttgattaaattgctatgtgaactgacaactatttataaatcaatgcaatagactgttgtttgaccaaattattttactgaactgacaagtgggtttttgatttgt

SEQ ID NO: 8715 - DNA, 572 bp, Homo sapiens
cctgcctcagcctcccaagtagctgggactacaggcatatgccaccacgcccagctaatttttgtgtttttagtacagacagggtttcaccgtgttagccaggctgatcttttgatccgcccacctcagcctcccaaagtgccaggaccacaggcgtgagccactgaacttggccgggacagctatttgtaaactagctatgtgaaaataaagggccatatccttggagtctagaattctcctttcactaagttatcaaaaattatattactttgaccacacaaaggtatttatctctggttcgtgcaaacactgaatgttggaagtaccgagtgataattggaaataaaaatctccaaacgtctagtaataaaaagactgatgggctaaattgtgtatttattcatacagaagattattagcctgttaaaaaacagtgagattttgtatagcaagatcacgggtttttttaatgaaaaaaatatgcatacaggtgtgtgcacatacctatatatttacttttttccccctctcactctgtgcccaagctggagtgtagaagcacactcatg

SEQ ID NO: 8716 - DNA, 420 bp, Homo sapiens
ctgtgacgcctgaataactgtctactttatcttcactgaaccactcactctgtgtaaaggccaacagatttttaatgtggttttcatatcaaaagatcatgttgggattaacttgcctttttccccaaaaaataaactctcaggcaagcatttctttaaagctattaagggagtatatacttgagtacttattgaaatggacagtaataagcaaatgttcttataatgctacctgatttctatgaaatgtgtttgacaagccaaaattctaggatgtagaaatctggaaagttcatttcctgggattcacttctccagggattttttaaagttaatttgggaaattaacagcagttcactttattgtgagtctttgccacatttgactgaattgagctgtcatttgtacatttaaagcag

SEQ ID NO: 8717 - DNA, 594 bp, Homo sapiens
  misc_feature (1)...(594): n = g, a, c or t
ccatcggtgctgaaattgagcattttaaatagtacagtaggctggtatacattaggaaatggactgcactggaggcaaatagaaaactaaagaaattagataggctggaaatgcttactttctgctctcattttctttcattttgtctgctgtctttttgaatgccaatactttcatttaaaatgttttgggagcacggcaacccaaaatgactgaacggtggtccaaaaatccaaaccaactgataattacttctcgaggtgataggaaaggcacaggaagttaggactttggctgaaatgatgaaaacacatgttcgccattttagggatcagcgcctcgactcctgccacctccggctccaacgatgatcatgtttggatgtatttattgaattgtcctttgctgatgaggaatttttaaagtatttcatagaataagtcctttggtatgcagatgggttcatgcaggtaattttaggtatagcccatcttccatttcctaagcaccggatagttggaaggtgacgttgaatgaaaccatctttgcagtggnatctaatcagggagttgatttcataacgagggttcatct

SEQ ID NO: 8718 - DNA, 608 bp, Homo sapiens
  misc_feature (1)...(608): n = g, a, c or t
cctccggtcacggttaaagccaagctgaggcttccactgccgtccattgctggatttttcccagtcactaggtttcagtactgctgctggctttcttgctcctggaagcattacagctttaaaaatgtaatcttcagcaaactgtgggtctttaaaattaatactgactacagtgttctgtgtcagatcccttaacataggaacaggagaacatactatttgatctggaagaatggcttcttcatccaaagaaaactttccttgaatcccatgacatagttcagggggtacctccactggctctgtggaacctgtctggtacagctctaaaatgaagtcatggagtgggtgatgtttccccacaaataagacatcacctccaaggctgtttcttctggtctcttctggagtgaggtctgggtatacctcttctagggcagctcgtagccttcgctcatccacgaatggcaagagagcaacaccttgccatgcatatttcttcccattcaaatcaatagcaaaatcttcaggatagaagtcaattatactagantcaggatcactcatgagcttccgccatgatggaggtagaaaattaccacttgcag

SEQ ID NO: 8719 - DNA, 517 bp, Homo sapiens
ctgtcctggcttggatacagctctggagtggtcaaaagagcgctctgtccctaatcatcaactctgctccaaaaaggaacctgaaaaaagctctaaactcacagatccaagaagcccagacattcccattgctgtcttcgaatgggattctaaagccagggggatgatgttttagggaatccttgaaactcctacaattataaacaggtgtgcatgaagaaaatacactaccatttaatgtcccaaacgccttataaggaaggtgaaggggacctagaaagccccttaagttcgcttagcatctcagtaagtggtctgagcatggaacagagtttgggagttgaagcaggagagacctgggttacactacaggtaaagaacatgggattttgaggcaactggggattaggaggtaaaaggaaaaggtgggagggggaagagtagaaccagtgaggtgctgtgaggctggagaccctgggaggtgaagcaggcaaggaagagtcccatgtcggggtgg

SEQ ID NO: 8720 - DNA, 454 bp, Homo sapiens; identical to SEQ ID NO: 8124

SEQ ID NO: 8721 - DNA, 456 bp, Homo sapiens
ctgaaaagaggacccaaaaagaaattggagatattgctggtgttgctgatgttacaatcagacagtcctatagactgatctatcctcgagccccagatctgtttcctacagacttcaaatttgacaccccagtggacaaactaccacagctataaattgaggcagctaacgtcaaattcttgaatacaaaactttgcctgttgtacatagcctatacaaaatgctgggttgagcctttcatgaggaaaaacaaaagacatggtacgcattccagggctgaatactattgcttggcattctgtatgtatatactagtgaaacatatttaatgatttaaatttcttatcaaatttcttttgtagcaatctaggaaactgtattttggaagatatttgaaattatgtaattcttgaataaaacatttttcaaaactgaaaaaaaaaaaaaaaaaaaaaa

SEQ ID NO: 8722 - DNA, 442 bp, Homo sapiens
  misc_feature (1)...(442): n = g, a, c or t
ctgtggccctgctcggattgagtatgcttgataggctttgggataagaagggacaaggtgcttctagccctgtctcagtccgttatcactctgctgtagaagggggacatgccacatgtattanaaggcatctgctgtaacttccagtgcaagataattcaataactgatgtcccatttcattcagagcccttattgctcttatcaaaacagaanaaggctacatttgtgggagtgttgtcatattctcaggccaactgttttgaaattcggtatctcactgagctaatctggaacaaacctctcacctcaggccanaaggggatgacctccatttgcttctctgagtagtttcctntgctgacattccaaatcccaccatcgattgtgcagcgctttggatttccttcagttctccaggtccacctggaaagtatagttgg

SEQ ID NO: 8723 - DNA, 545 bp, Homo sapiens
  misc_feature (1)...(545): n = g, a, c or t
cccccgtctgaggactgacctttttccaaagacgagaatccaggacttgaatcgtatcttcccactttctgaggactactctggatcaggcttcggctccggctccggctctggatcaggatctgggagtggcttcctaacggaaatggaacaggattaccaactagtagacgaaagtgatgctttccatgacaaccttaggtctcttgacaggaatctgccctcagacagccaggacttgggtcaacatggattagaagaggattttatgttataaaagaggattttcccaccttgacaccaggcaatgtagttagcatattttatgtaccatggttatatgattaatcttgggacaaagaattttatagaaatttttaaacatctgaaaaagaagcttaagttttatcatccttttttttctcatgaattcttaaaggattatgctttaatgctgntatctatcttattgttcttgaaaatacctgcattttttggtatcatgttcaaccaacatcattatgaaattaattagattcccatgg

SEQ ID NO: 8724 - DNA, 449 bp, Homo sapiens
  misc_feature (1)...(449): n = g, a, c or t
ctggagagtgtngatcccaaaaattacccaaagaagaanatggaaaagcgatttgtcttcaacaagatngaaatcaataacaagctggaatttgagtctgcccagntccccaactggtacatnagcacctntcaagcagaaaacatgcccgtcttcctgggagggaccaaaggcggncaggatataactgacttnaccatgcaatttgtgncttcctaaagagagctgtacccanagagtcctgtgctgaatgtggactcaatccctagggctggcagaaagggaacagaaaggtttttgantacggntatagcctggactttcctgttgtctacaccaatgcccaactgnctgccttagggtagtgctaagaggatctcctgtccatcagccaggacagtnngctctctcctttcagggccaatccccagcccttttgttgagccagg

SEQ ID NO: 8725 - DNA, 246 bp, Homo sapiens
gacaccgggtgtagagggcggtcgcggcgggcagtggcggcagaatgttggctaccagggtatttagcctagttggcaagcgagcaatttccacctctgtgtgtgtacgagctcatgaaagtgttgtgaagagcgaagacttttcgctcccagcttatatggatcggcgtgaccaccccttgccggaggtggcccatgtcaagcacctgtctgccagccagaaggcactgaaggagaaggagaagg

SEQ ID NO: 8726 - DNA, 568 bp, Homo sapiens
ccagtggaatgatgttccctgcaattaccatctcacctatacgtgcaagaaaggaacagtcgcttgcggccagccccctgttgtagaaaatgccaagacctttggaaagatgaaacctcgttatgaaatcaactccctgattagataccactgcaaagatggtttcattcaacgtcaccttccaactatccggtgcttaggaaatggaagatgggctatacctaaaattacctgcatgaacccatctgcataccaaaggacttattctatgaaatactttaaaaattcctcatcagcaaaggacaattcaataaatacatccaaacatgatcatcgttggagccggaggtggcaggagtcgaggcgctgatccctaaaatggcgaacatgtgttttcatcatttcagccaaagtcctaacttcctgtgcctttcctatcacctcgagaagtaattatcagttggtttggatttttggaccaccgttcagtcattttgggttgccgtgctcccaaaacattttaaatgaaagtattggcattcaaaaagacagcagacaaaatgaaaga

SEQ ID NO: 8727 - DNA, 352 bp, Homo sapiens
ggagaggtaaaaatgttgtacatcagctctcagtaaccctagaagacttatataatggtgcaacaagaaaactggctctgcaaaagaatgtgatttgtgacaaatgtgaaggtagaggaggtaagaaaggagcagtagagtgctgtcccaattgccgaggtactggaatgcaaataagaattcatcagataggacctggaatggttcagcaaattcagtctgtgtgcatggagtgccagggccatggggagcggatcagtcctaaagatagatgtaaaagctgcaacggaaggaagatagttcgagagaagaaaattttagaagttcatattgacaaaggcatgaaagatgg

SEQ ID NO: 8728 - DNA, 392 bp, Homo sapiens
ccttggatgcagatcaatgctccaataaagttcattatcagctcctcctgccttgtgacaggatgatttgattttacaaaagtccctttgaaaacaagagtaaacgcagacagcttctagagaaaagtctggtgaagcagcagttgataatagattttcttttagtgatgaaattaatcttgttttggtaatctacagcctgttagggataggtggagggatgaagtccttaaaactaaattgttcctctacgaatcttcgacctgagcctgcggagagagtagccccaaatccatctctctgctgaaaggtcgcctgttttggtaggtgtgaggacattccgaaacacggccatccacattctgatacatcgcttcttctgcatctgtcag

SEQ ID NO: 8729 - DNA, 608 bp, Homo sapiens
  misc_feature (1)...(608): n = g, a, c or t
gctgggagagctagactaagttggtcatgatgcagaagctactcaaatgcagtcggcttgtcctggctcttgccctcatcctggttctggaatcctcagttcaaggttatcctacgcagagagccaggtaccaatgggtgcgctgcaatccagacagtaattctgcaaactgccttgaagaaaaaggaccaatgttcgaactacttccaggtgaatccaacaagatcccccgtctgaggactgacctttttccaaagacgagaatccaggacttgaatcgtatcttcccactttctgaggactactctggatcaggcttcggctccggctccggctctggatcaggatctgggagtggcttcctaacggaaatggaacaggattaccaactagtagacgaaagtgatgctttccatgacaaccttaggtctcttgacaggaatctgccctcagacagccaggacttgggtcaacatggattagaagaggattttatgttataaaagaggattttcccaccttgacaccaggcaatgtagttagcatattttatgtaccatggntatatgattaatcttgggacaaagaattttatagaaatttttaaa

SEQ ID NO: 8730 - DNA, 600 bp, Homo sapiens
gatcacctgaggtcaggagttcaagaccagcctgaccgacatggtagaaccccgtctctattaaaaatacaaaaaattagctgggtgtggtggtgcatgcctgtaatcccagctacctgggaggctgaggtataagaattgcttgaacctgggaggtagaggttgcagtgagctgataccgtaccattgcactccagcctgatcaaccagagcgaaaatccatcaaaaaagaaaaaaaaaggaaggaaggaagggagggagggaaagaaggaaagaaggaaggaaggaaggaagaaaaaagtggggcaaggcagcaagaagatgctgacttgttttcagcaatcatcagttatgattacttctcttcttttaccaaaaacttggacctccagcttcctgtaaacctttatcccagctcttactggtagacatgcagtgaagccagagggaataacaagtacccagcacttgaaaaacactttcagtcaagcatggtggcacatctgtagtccccgctacttgggaggctgaggtaggacgatcacttgagcccagagttcgaggctgcgatgagctatgattgcacctgtgaatagccat

SEQ ID NO: 8731 - DNA, 604 bp, Homo sapiens
ctgcacatggattggttaacataatatatactgctatataatcttttaagggctaatatttgtagataatttaaaagcatgtcaatttcctctaagatttgattatttaacctgcacaaaggccaatcttcagttatcaatgacaagaaaactctagggctgccaaaataacttcattttagaccccagagttagtgttaggctggtaatgtttctaatttgggaataatgagactagaaagctaggagggccccctccaaatttctcccttgtattaggctgaagtagaacataacgtggcttaaagcataaacttaaagcatatgctttgagttttaaaaatgttaacctgtaattaattattagagtattatccatagtctactatgatagtcagttaatattctctaaatcagattatattcatttgaaaatgcatctgcatatttgcaaatgtgttattacacaagatcttacctatgtcaatttaaagaggttaaagatgcaggaagcccccactaaaatgtaaacacatttgtacggttttcagaatgtttggactcattctttcccattgacagagcagtaggttttaattagagt

SEQ ID NO: 8732 - DNA, 604 bp, Homo sapiens
cctagatcattcatattgtacattgacatttttacataaatggaattaatactacttaccatttgagtaaagaacacaaggaattgaagagtctgtgaaaatatgtcctgtttgtgaaaggtgaaactgtccaatccatgtccaatcaatgtcagtcgtccagtattggtggtgattattaaacttattggaggtacaactttacctccaataagcttacctttacaagcttctgctttccctgcttcatctctgttatgggctatcagtccagcttggtgtgaaaatgagactatatctataccacagcccccaatcctttcaaaggctttgcatgtatttcagctacaagtgacaaggatattaaggatttaaaaggataagagagtgggaaagatgtataaggaagtgcctttgtcaaaaggcagcaaaaagtataatgatataaacataatatgaaataagcaaattttagaatactttgaaacagatttatagaggaatacatagtaaatagttatagacacacatttggggcatttttaataaggttagcaagaagaaatttgcatgagtaatgagcaatgtgaaatgggcattatac

SEQ ID NO: 8733 - DNA, 563 bp, Homo sapiens
ctgcgcaaggagtcccagaaagaccgcaagaacccgctgccccccagcgttggcgtggttgacaagaaagaggagacgcagccgcccgtggcgcttaagaaagaaggaataagacgagttggaagaagacctgatcaacaacttcagggtgaagggaaaataattgatagaagaccagaaaggcgaccacctcgtgaacgaagattcgaaaagccacttgaagaaaagggtgaaggaggcgaattttcagttgatagaccgattattgaccgacctattcgaggtcgtggtggtcttggaagaggtcgagggggccgtggacgtggaatgggccgaggagatggatttgattctcgtggcaaacgtgaatttgataggcatagtggaagtgatagatcttctttttcacattacagtggcctgaagcacgaggacaaacgtggaggtagcggatctcacaactggggaactgtcaaagacgaattaactgacttggatcaatcaaatgtgactgaggaaacacctgaaggtgaagaacatcatccagtggcagacactgaaaa

SEQ ID NO: 8734 - DNA, 600 bp, Homo sapiens
ctggctccagggatggtacaacagatgcagtctgtgtgctctgattgtaatggagaaggagaggtaattaatgaaaaagaccgctgtaaaaaatgtgaagggaagaaggtgattaaagaagtcaagattcttgaagtccacgtagacaaaggcatgaaacatggacagagaattacattcactggggaagcagaccaggccccaggagtggaacccggagacattgttcttttgctacaggagaaagaacatgaggtatttcagagagatgggaatgatttgcacatgacatataaaataggacttgttgaagctctatgtggatttcagttcacatttaagcaccttgatggacgtcagattgtggtgaaatacccccctggcaaagtaattgaaccagggtgtgttcgtgtagttcgaggtgaagggatgccgcagtatcgtaatccctttgaaaaaggtgatctttacataaagtttgatgtgcagtttcctgaaaacaactggatcaacccagacaagctttctgaactagaagatcttctgccatctagaccggaagttcctaacataattggagaaacagaggaggtagagctt

SEQ ID NO: 8735 - DNA, 594 bp, Homo sapiens
cctacctgcaagaggaattgaagattaaacgttctctcttcaactaccatgacacgaggatccatgcctgcctctactttattgcccctactggacattcactaaagtccctggatctggtcaccatgaaaaagctggacagtaaggtgaacatcattccaataattgcaaaagctgacaccattgccaagaatgaactgcacaaattcaagagtaagatcatgagtgaactggtcagcaatggggtccagatatatcagtttcccactgatgaagaaacggtggcagagattaacgcaacaatgagtgtccatctcccatttgcagtggttgacagcaccgaagaggtgaagattggcaacaagatggcaaaggccaggcagtacccctggggtgtggtgcaggttgagaatgaaaatcattgcgattttgtgaaacttcgagagatgctgatccgcgtgaacatggaggacttgcgagagcagactcacacccgccactatgaattgtaccgacgctgtaagcttgaagagatggggttcaaggacactgaccctgacagcaaacccttcagtcttcaggagacatatgaag

SEQ ID NO: 8736 - DNA, 600 bp, Homo sapiens
cttgtaactatcaaaatgaatagttcatttttgatagatttgttgtgcagccattatgaattaaatggtttattaggagtttgactaaatttttatttttagtgtgtatagcatgaatactaccaaaggagacgacaaacttgcagcttaaaatgggcaccagttcccacactggcttaatttatataactgcttggctgtattgcgggtaataatattagaagcaagaagcacttcatttttaaaagagatgttactataatattgcttaaatgctttagcacttggacttcttgagatgcagatgtgtgatttggagtgctggcttatttaaaggtcaagccaaggagtttgtggttcagccacaactactgttttctaagactattgatgtgaaggacttagtgaagtaatttttatattctgggcttcccagcaagatgtcctttttatgactgccatgcttcttttggactcagtaaatatttgtaatgttagaaaagtctcattatttttataaaatgcatgacattttaagtatgtgttgcataaaatggattatagcagttctcatggtttaggatttttaagaaatagtcc

SEQ ID NO: 8737 - DNA, 329 bp, Homo sapiens
  misc_feature (1)...(329): n = g, a, c or t
gcccannacctctgcaaggtctgctcgttactatgcatgangtnngctatgatggnggcacanctgnngctgataccaatgaagtgacacatgtggcgtaagaagggaagaatctgggcttccggggaatcttctatccggatgtgcagaagcttgtcagcatcgcctgcaaaaaagggccctgtatccatggagacattgacatgggctttgattttcaagtccttctgaatcttggggtcacaggcttgactgaaattgccaacgaagaccttccctggcacgatttcaatggggtatggcntgaaatgcatccagttcctgaggca

SEQ ID NO: 8738 - DNA, 607 bp, Homo sapiens
ctgataatttacaatgtcataaagtttccagtttcacaatacaaaaaggataaaatgaaattgggtatcattttgttgcaatttatagaactttacccatacctgtaagaccctcaatgtatatgaaatcattttcactgggaaagtgacagttacagtaaaagcagaaccacacaaatctttatttaaaagccgaaatatcagccttctctctctcttttgctatttgaaaggtagtcttcaatttggcaggcaactgcttctctctccaaatagtaacaggttacaaacatgctactttaaatatgaataggacctaaggctttagtattttaaatcttgcccaatacagaaatgcctttcaagagactttagtgatgcttaatttatgaacaacaaggaattattttccttttgattattcactttttcaaaactcatagatcagaataaacaaaaaatcccccaacccatggtggggacacaaaagtaacataagtgactaaggtgtgccattcatagagaggttgaagactccatgccccaggaccacttagctgcaatagggtgaaatagtctactttttgatttcatgaatttttttcta

SEQ ID NO: 8739 - DNA, 279 bp, Homo sapiens
  misc_feature (1)...(279): n = g, a, c or t
tttttttttttttttttttttttactcataaaaaacattttactttaattatagggtncaaataanagtcttaacacanaaatcctacctcctatttaagatataaatacttgatgatntaatcaatcaanagggattaattaatgtcagttgaaaatctaatgacttaaatccataaatgccatttgcttttgtctggaanatttaaactgatttaagggngacacacagcanagttctagnggacattcgtgttaaccgtttggngctcaaaatgga

SEQ ID NO: 8740 - DNA, 605 bp, Homo sapiens
ctgtggctgtctgtcagagaagcacatttttctgcagataattagaatggcttcccccatctctcacggactgtcccaagtctagaaaagaattgagttcctcttctattagtcaaataaaagggaagagaatgtttgtcttcctttcctttctgtagtgttaagaaaataaacgaacttaatgattctaaattatcagtgagcttaacactgtactatagaccaaagattaccttttcaaaaagtcctttgaggtgaaatattttgtatacgtaatacatagatgcacatataaacacacacatatagaatctcaatattttaacacttctttgggtagttgtactaactcactaaccctgaggaaaaagttaagaaattgaaagtgttttcttcaaaagttgagatttaacaataaaaggtgttactttgataactaaaaggaactttattatcctcttcctaaaataaaccaatgcctattctgaaaatggcacttgcaattacaatttgccattatcaaagctaccactgaggtagaggcattatctaaaacaaataccacttatcatttattggcagttacctcgagagagacccataca

SEQ ID NO: 8741 - DNA, 596 bp, Homo sapiens
  misc_feature (1)...(596): n = g, a, c or t
ctgggagagctagactaagttggtcatgatgcagaagctactcaaatgcagtcggcttgtcctggctcttgccctcatcctggttctggaatcctcagttcaaggttatcctacgcagagagccaggtaccaatgggtgcgctgcaatccagacagtaattctgcaaactgccttgaagaaaaaggaccaatgttcgaactacttccaggtgaatccaacaagatcccccgtctgaggactgacctttttccaaagacgagaatccaggacttgaatcgtatcttcccactttctgaggactactctggatcaggcttcggctccggctccggctctggatcaggatctgggagtggcttcctaacggaaatggaacaggattaccaactagtagacgaaagtgatgctttccatgacaaccttaggtctcttgacaggaatctgccctcagacagccaggacttgggtcaacatggattagaagaggattttatgttataaaagaggattttcccaccttgacaccaggcaatgtagttagcatattttatgtaccatggntatatgattaatcttgggacaaagaattttatag

SEQ ID NO: 8742 - DNA, 596 bp, Homo sapiens
ctgaaagtttttgaaacaaatatttgaaaaccaggtatccacacatagcacttttattcctgactagttttgcacacttgaaaattgtttacttattttacaactgttttactgatgctatctttattgtttttgccgtattctgacatgtcaaatctatgccttgaattatatcatctcttttcctgtgggtttcatttgttaaattcattggattttaataatataaaagtatagctaattgttcagttttaactatttttaattatcttcttaacaaataagaagttgctttaaacattaaccaattttctatatttagctatacagagtaattgaacttaacatgtttttgtcaacaccaattacattttcagcttttaaaaatggtagcttttgtgaaatagaatcagtgaccagtatagcacttagatcccttctaactcatataatttttctcagccaatccattcacaagcttggcattgacatgtgctgctagtttataaactggcattgacgaaaatcatttgaatctcttctgctgagataatttgccaatgcaaaatacagttgtcattaatcctgcacattag

SEQ ID NO: 8743 - DNA, 601 bp, Homo sapiens
cctgtttgattgtagctatgttggtgtatctcgtgtacaagatggaaaagtgcttttgttgttctacctgatccagttgggggagcaggaatagggggtgcctgcctaacggcctctagcccatgtgcttatactgggatctgtcccgagggatctgcacctggttggcagtcattttgtggtggacgtggtaaatcgcgagtgttaccatgatgacgaggcccaagatgagccccaaaatcaggggcaaggtttcttccagttgctcccgctcatccactgggcatttatgctcttcactgaagacaaaatctgagataatgtcaaaaggttggatgtggaccgcagacaggatcatggtgaccgtcttctgcggatcactagaggccagtgaaatggtttgttgagcttgacactcataggacttcccagcgggggtgaccaaggcagagaggtggtgcgagttggctgtgtgcttcccagcactgactgcgtctttgaagtgggttttctccgaggagtcgtagacaaactgcactttgctcagcctccaagtcgcctcaggtcccttggacatgttgtggctttcctttacaaagag

SEQ ID NO: 8744 - DNA, 488 bp, Homo sapiens
cctactatgggtgttaaattttttactctctctacaaggttttttcctagtgtccaaagagctgttcctctttggactaacagttaaatttacaaggggatttagagggttctgtgggcaaatttaaagttgaactaagattctatcttggacaaccagctatcaccaggctcggtaggtttgtcgcctctacctataaatcttcccactattttgctacatagacgggtgtgctcttttagctgttcttaggtagctcgtctggtttcgggggtcttagctttggctctccttgcaaagttatttctagttaattcattatgcagaaggtataggggttagtccttgctatattatgcttggttataatttttcatctttcccttgcggtactatatctattgcgccaggtttcaatttctatcgcctatactttatttgggtaaatggtttggctaaggttgtctggtagtaaggtggagtgggtt

SEQ ID NO: 8745 - DNA, 383 bp, Homo sapiens
ctgtagagtgggcttatcatctttcaacacgcaggacaggtacagattcttttccttgaggcccaaggccacaggtattttgtcattactttcttctccttgtacaaaggacatggagaacaccacttgttgctccatatcctgtccctggaggtggagagctttcagttcatatggaccagacatcaccaagcttttttgctgtgagtcccggagcgtgcagttcagtgatcgtacaggtgcatcgtgcacataagcctcgttatcccatgtgtcgaagaagataggttcttcttcaaagatgaagggaaagaaggtgctcaggtcattctcctggaaggtctgtgggcagggaaccagcatcttcctcagcttgtccatgg

SEQ ID NO: 8746 - DNA, 368 bp, Homo sapiens; identical to SEQ ID NO: 8376

SEQ ID NO: 8747 - DNA, 605 bp, Homo sapiens
  misc_feature (1)...(605): n = g, a, c or t
cctctacaacnctgaatgnggaatattttaaatgtaatctaaggaataaccactagggtgtggtaagtgaatatcagagtaaggctcatggagaacatggagtacttcctaaatcataattttattataaaatgacggaattactagttgtaattactgaatagcctatattgctatttattgtgtgtttcatcactttaggggtctagtatggtggatgttagtaattatctaagtgaatgaagaagcactccagtggaaagttcttatatgccattatgttcttttcctggcccagtgcctaagtgaagtaggtgtttataacttaacctaaacgtactaagatttcagatcaataaagttattaaaataaaattggtaccagccaattttcaaataaggttgctttttattttttaagtaaaattatgtttataattaaaccataagacaaatagtattttttttaaaaaagaaaagaatgtagttttattaataatttactgcattgntctcattctcaatttactgnggaccattagaaacttgtgtatagtctggcagtggaaaccatcagtgtttggaaatgaatggttgaaaaggct

SEQ ID NO: 8748 - DNA, 308 bp, Homo sapiens
ccagtttaggccggaaaagaatcatccattgcagatcagagcctttgctaaattgctgaataagaagatggttgagtcacctccttcgcttaaacttgtcctcattggaggttgtcgtaacaaagatgatgaacttagggtaaaccaactgagaaggctgtctgaggatttaggagttcaagaatatgtggaatttaaaataaacattccatttgatgaattaaagaattatttgtctgaagcaacaattggtctgcataccatgtggaacgagcattttgggattggagttgtggagtgtatggcag

SEQ ID NO: 8749 - DNA, 306 bp, Homo sapiens
aggttcggccttaacatagatcgatggttgacaatccagagtggtgaacagccctacaagatggctggtcgatgccatgcttttgaaaaagaatggatagaatgtgcacatggaatcggttatactcgggcagagaaagagtgcaagatagaatatgatgatttcgtagagtgtttgcttcggcagaaaacgatgagacgtgcaggtaccatcaggaagcagcgggataagctgataaaggaaggaaagtacacccctccacctcaccacattggcaagggggagcctcggccctgaacagagcag

SEQ ID NO: 8750 - DNA, 125 bp, Homo sapiens
ctggggccccatcatcatgggctgagagctccatgtctgtggggagctccttggcaacaggctgcagtaggacaggatgtgcttcatcgtctatttgggcttcctcagcgtcacccatggtacag

SEQ ID NO: 8751 - DNA, 193 bp, Homo sapiens
gttacacgcgggttcaacatgcgtatcgaaaagtgttatttctgttcggggcccatctatcctggacacggcatgatgttcgtccgcaacgattgcaaggtgttcagattttgcaaatctaaatgtcataaaaactttaaaaagaagcgcaatcctcgcaaagttaggtggaccaaagcattccggaaagcag

SEQ ID NO: 8752 - DNA, 604 bp, Homo sapiens
  misc_feature (1)...(604): n = g, a, c or t
ggcaggtgtggtgccttggctaagtccacagacttctgagaggcccacgctttcttcttctccagaaataaaccctgaaactcaagcagctttaatcagagggcaggattccacgatagcagcatcagaacagcaagtggcagcgagaattcttgattccaatgatcaggcaacagtaaaccctgtggaatttaatactgaggttgcaacaccaccattttcccttctggagacttctaatgaaacagatttcctgattggcattaatgaagagtcagtggaaggcacggcaatctatttaccaggacctgatcgctgcaaaatgaacccgtgccttaacggaggcacctgttatcctactgaaacttcctacgtatgcacctgtgtgccaggatacagcggagaccagtgtgaacttgattttgatgaatgtcactctaatccctgtcgtaatggagccacttgtgttgatggntttaacacattcaggtgcctctgccttccaagttatgttggtgcactttgtgagcaagataccgagacatgtgactatggntggcacaaattccaagggcagtgctacaaatactttgcccatcgacgc

SEQ ID NO: 8753 - DNA, 126 bp, Homo sapiens
ccacacccaggagggttgattggcaggctggaagacaaaagtctcccaataaaggcacttttacctcaaagagggggtgggagttggtctgctgggaatgttgttgttggggtggggaggagttat

SEQ ID NO: 8754 - DNA, 494 bp, Homo sapiens; identical to SEQ ID NO: 8713

SEQ ID NO: 8755 - DNA, 597 bp, Homo sapiens
ccatcggtgctgaaattgagcattttaaatagtacagtaggctggtatacattaggaaatggactgcactggaggcaaatagaaaactaaagaaattagataggctggaaatgcttactttctgctctcattttctttcattttgtctgctgtctttttgaatgccaatactttcatttaaaatgttttgggagcacggcaacccaaaatgactgaacggtggtccaaaaatccaaaccaactgataattacttctcgaggtgataggaaaggcacaggaagttaggactttggctgaaatgatgaaaacacatgttcgccattttagggatcagcgcctcgactcctgccacctccggctccaacgatgatcatgtttggatgtatttattgaattgtcctttgctgatgaggaatttttaaagtatttcatagaataagtcctttggtatgcagatgctacatggaaggaaagaaagaaaaaaagaaaacacacaatattacttgctccataccctaaactgccgataccacagccgtaaaatgaaggtgtctagtagttgttatagcacggtagtccattctttctaaaggacc

SEQ ID NO: 8756 - DNA, 589 bp, Homo sapiens
cgcgtgcataaaaactggttctacaaatttttacttgaagtaccaggccgtttgctttttcaggttgttttgttttatagtattaagtgaaattttaaatgcacagttctatttgctatctgaactaattcatttattaagtatatttgtaaaagctaaggctcgagttaaaacaatgaagtgttttacaatgatttgtaaaggactatttataactaatatggttttgttttcaatgaattaagaaagattaaatatatctttgtaaattattttatgtcatagtttaattggtctaccaagtaagacatctcaaatacagtagtataatgtatgaattttgtaagtataagaaattttattagacattctcttactttttgtaaatgctgtaaatatttcataaattaacaaagtgtcactccataaaaagaaaactaatactaatagcctaaaagattttgtgaaatttcatgaaaactttttaatggcaataatgactaaagacctgctgtaataaatgtattaactgaaacctaacactgtttcagggctgtgagtgtgcatgtgttggaaatgtgcatggtgg

SEQ ID NO: 8757 - DNA, 603 bp, Homo sapiens
ccacagaacagtccctttttgagtaaagcagcaaggttgcttaatgacatgctatgtggttaacaagattcaactgccacatcaaggactttaaataatttcaagattttaaatgtatttatgaaatgaactcattacagcagctaatcaatgcaaactttgtcctttttctttgtctttctaagagaaactgaatttaatttaaatttaaattacagtgtctaaaacttggtaaaatattttaaatttgaataagaggaaaaaaaaaacatgaatttatttatgatggagcttcatacccaggacagtagcttcttaaatgttagtaaaataattatgttaagcattaaaacaattttgaatatgtaattaagcatttatgttaaaaaacatgtttcttacgtgtgtgtgtatatatttataactgacacatgtgattctttgtacagtatttagaatccttcccttcagatagcagtcctcttgtattcagtcttgtggctaaaatagatcaaaaacatattttaaaactgttaaagtaactgtatgactcatgcttgaagttctgaaatttgggagcgttatgaggtttccatgccatta

SEQ ID NO: 8758 - DNA, 591 bp, Homo sapiens
  misc_feature (1)...(591): n = g, a, c or t
cgcgtggatggatacagagcggcttctacacggcgccatcaacattctctttatgaacgtgagtggattctccaggcaaactatgcactatttcatggtcggaaagaatcaaaggaagtttaaatgagggtggagttaaactgtgctaaattacagtagtgcttattagtaactagatttcaaaaggttacagaaaatttacattctctacacaaaaactgcatctcctgcacagacaacatcgacatcgacacaggaaggaaactgattgtccattctttgcccaggaagtctcggtactttatagattcgtctttacctcttttttgttgttgttcttccgaaaaagcagtttaaatttttttctttttctttttatgctagggacgtggagatgttaaaacgacaacaaaaaatatatatataaaaacaggaatgaaatctgtgagagaatatttttggttctaaagacgggtgcatccgtttgtcttcgcccgaatcccttgctggagaccacacgagcagtgacattgcacggagagggcagctttgggttccgccgccgtcactgaaaccaccggaaggcggntc

SEQ ID NO: 8759 - DNA, 559 bp, Homo sapiens
  misc_feature (1)...(559): n = g, a, c or t
gtgcgctgcaatccagacagtaattctgcaaactgccttgaagaaaaaggaccaatgttcgaactacttccaggtgaatccaacaagatcccccgtctgaggactgacctttttccaaagacgagaatccaggacttgaatcgtatcttcccactttctgaggactactctggatcaggcttcggctccggctccggctctggatcaggatctgggagtggcttcctaacggaaatggaacaggattaccaactagtagacgaaagtgatgctttccatgacaaccttaggtctcttgacaggaatctgccctcagacagccaggacttgggtcaacatggattanaagaggattttatgttataaaagaggattttcccaccttgacaccaggcaatgtagttagcatattttatgtaccatggttatatgattaatcttgggacaaagaattttatagaaatttttaaacatctgaaaaagaagcttaagttttatcatccttttttttctcatgaattcttaaaggattatgctttaatgctgntatctatcttat

SEQ ID NO: 8760 - DNA, 343 bp, Homo sapiens; identical to SEQ ID NO: 4922

SEQ ID NO: 8761 - DNA, 549 bp, Homo sapiens
  misc_feature (1)...(549): n = g, a, c or t
ccttaagcatttgctaaacaggttcaagtaagtttagtaaagtttcattactgccattgattcaattatcaaactgcttttgtacatataaagaattcttcagatgcatggtttctattaacaagatccaatgccttccttttatttccccttcagttcaacatctaatatataaagattgctctgactactacgcaataggcaaaagaagcagtgagacctacagagttacacctgatcccaaaaatagtagctttgaagtttactgtgacatggagaccatggggggaggctggacagtgctgcaggcacgtctcgatgggagcaccaacttcaccagaacatggcaagactacaaagcaggctttggaaacctcagaagggaattttggctggggaacgataaaattcatcttctgaccaagagtaaggaaatgattctgagaatagatcttgaagactttaatggtgtcgaactatatgccttgtatgatcagttttatgtggctaatgagtttctcaaatatcgnttacacgttggtaactata

SEQ ID NO: 8762 - DNA, 440 bp, Homo sapiens
cctgagctgtcatgcccaagggagacccagagacccaaattttcagtaaaaacttggaagagactctgattttgtttagaatagtggggggtggggacgaaatggggatgaggttgccagggtggagtgagacagcatcttggccctgggagtgtgggaaatttatgagtccttagatgaacagttaacaaaagttatgatgctaatggaaggcatcatagcttatttataagatgatacttaaacacttatgtgacatttaccatgtgctttggaggaggcacttttgttatcagccccatttccacagataagaaaactgaagcccagagaaataggtaagtggccccagcttacacagcttgcaagttgcggagccagggctggagctccaaaagcgctgcttggggtccacgcacttacctgttacttggcccagc

SEQ ID NO: 8763 - DNA, 159 bp, Homo sapiens; identical to SEQ ID NO: 7615

SEQ ID NO: 8764 - DNA, 332 bp, Homo sapiens
cctcagagtctgagtatagcctactccaattaagctagagttgttgacttttgcagaaatggaagcagtgggatccaactgatatttagctgcaatgccaaaacgagtgcagttggtacctgatgtccaagcaaggtttactgaagtgtcaagatcttcacaaactttctgataaattgatcctccaaattctgtcccatcattgacattagtgtgtagctggaagtccccagtcctgtagcccactgcaaagttattccttgtcagctttgatttggcactgtcaaaggtcatctggtagccagcaagccagccctcataaccaaagacag

SEQ ID NO: 8765 - DNA, 174 bp, Homo sapiens
cctggctcaacaaaagggctggggattggccctgaaaggagagagctgactgtcctggctgatggacaggagatcctcttagcactaccctaaggcaggcagttgggcattggtgtagacaacaggaaagtccaggctatagccgtactcaaaaacctttctgttccctttctg

SEQ ID NO: 8766 - DNA, 600 bp, Homo sapiens
ctggcaatgacaagactgggagtatcaaactaggattgttagttcaattaaaatttcagataaacaataatgtacttatactaaaaaattatttgttgtttatctgaaatgaaaatttaactgggtacccaattgtttgtttgtttaatctaaaaaccctgattgaaatttatctaataaaacatcatttaatatctaaaataaaataaatttactataacatctttataactattcaatcaatgattcatcttctatttttccaaattcttgcacaaatatttgatgcttaaataaatacataaataataaataggttaataagttacacttgaaaataatttatgttatgatgaaaaaacttaaagtgcttccacatgtcctcacaacatcactgtgaggtaagatggtggctaatactttttccacttagaaataaaggagaaaccaaggcacagtggaacaaggacttgtggatcctggctagcagactagggttgccagatttaacagaaaaaaatccaggatttccagctaaatttgactttatggcaaaatttattgtcccatcatttttatgtgatgcttcaaatatcacat

SEQ ID NO: 8767 - DNA, 600 bp, Homo sapiens
  misc_feature (1)...(600): n = g, a, c or t
ctgaggtggcagatagtgagcgctggtggcggagttaaagtcaaagcaggagagtaattatgaatagcgcagcgggattctcacacctagaccgtcgcgagcgggttctcaagttaggggagagtttcgagaagcagccgcgctgcgccttccacactgtgcgctatgacttcaaacctgcttctattgacacttcttctgaaggataccttgaggttggcgaaggtgaacaggtgaccataactctgccaaatatagaaggttcaactccaccagtaactgttttcaaaggttcaaaaaaaccttacttaaaagaatgcattttgattattaaccatgatactggagaatgtcggctagaaaaactcagcagcaacatcactgtaaaaaaaacaagagttgaaggaagcagtaaaattcagtatcgtaaagaacaacagcaacaacaaatgtggaattcagccaggactcccaatcttgtaaaacattctccatctgaagataagatgtccccagcatctccaatagatgatatcgaaagagaactgaaggcagaagctagtctaatggaccagatgagtagttgngatagttcatcag

SEQ ID NO: 8768 - DNA, 602 bp, Homo sapiens
  misc_feature (1)...(602): n = g, a, c or t
ccattgcaaagaaagcttctgtgaacattgctcctatgtcttttggtggacacatgcttccatttctccagggcagatacctaggagtggggttgctggtgtttggtgtgagtagtgtctgtttaggtttataaataacctgcccaactcttttccaactgtaccattttgcatttccaccagcagtgtgaacattccagtgtccccacccctctacccttgccagcacttggtgatgtcagtcttttctttttattgattctagtgagtatggagtggtattctgttgtagttttgacttgcatttcccaagactaatgacactgagcgctttttcatgtgcttacttgtcattcgtagtatcttctttggatagacaccttcatacattctaatttcactggcaaacgattatcccaaaatggattaatttatgactggngtctattatatcacataatgctgtgttaagtcttagggatgaaaganaaggnctgtgtgtacttctttttttctccccaaaaccacttattgagatggctagtgagataaaggtcatgttaagcagggcacagcagagttggaggagatggacaggaatg

SEQ ID NO: 8769 - DNA, 607 bp, Homo sapiens
  misc_feature (1)...(607): n = g, a, c or t
tcctactccgatgacaagttttatgcaactaatgacactgaggtcgcccagagcaattttgaggcccttcaagatttcttccgcctctttccggagtacaagaacaacaaacttttcctgaccggggagagctatgctggcatctacatccccaccctggccgtgctggtcatgcaggatcccagcatgaaccttcaggggctggctgtgggcaatggactctcctcctatgagcagaatgacaactccctggtctactttgcctactaccatggccttctggggaacaggctttggtcttctctccagacccactgctgctctcaaaacaagtgtaacttctatgacaacaaagacctggaatgcgtgaccaatcttcaggaagtggcccgcatcgtgggcaactctggcctcaacatctacaatctctatgccccgtgtgctggaggggtgcccagccattttaggtatgagaaggacactgttgtggtccaggatttgggcaacatcttcactcgcctgccactcaagcggatgtggcatcaggcactgntgcgctcaggggataaagtgcgcatggaccccccctgcaccaacacaacagacc

SEQ ID NO: 8770 - DNA, 537 bp, Homo sapiens
ctgttagggctgaatcttctggagaaaaaggtgccatctcaggagaatagcttttactctggtaggaatgcttccgagacaccacaaggcagcctgaacactcagttgcagggtcgggcttgcggtgggtgacccagagccaccaaagtcacatccacaactaatgagggaaatctgtaaagccagttagatagaagaattttatttttctgtgggttttgtgttgtcttttttatgttaaaaagaaatccagtttgtgtttttctatagaaaaagtaaaagatcaggttatactttaggttaggggttctatttattcctgttagtaaataaaattaacaaatttctttgtttaacaaaagattaatctttaaaccactaaaatacatagactgattgattattcaacacattggaattgatgtcggtcatagtttcctgaagcatttagttacaacctgaaggaataaaatgatttgtggaaatgcttaaaatagacctaactgaatacagtctcatcttgccgcgcctggctta

SEQ ID NO: 8771 - DNA, 229 bp, Homo sapiens
  misc_feature (1)...(229): n = g, a, c or t
catatatttcgggtttatcnaagcancttcnccagggacgtgaaggaattcgccaaaatgctacgcttatcctatccctnggagctccaggtgtccgctggctgtgaggtgcaccctgggaacgcctcaaataacttnttccatgtagcatttcaaggaaaagatatcctgagtttccaaggaacttcttgggagccaacccaagaggccccactttgggtnaacttgg

SEQ ID NO: 8772 - DNA, 516 bp, Homo sapiens
ctgctaataatgcttatactatatttgtagcttaactagatgttaaactatggaactgttggtgccaatctgcttataaaggcaatgctctggagacaaagtcttctcacaaacagtgggcaagcaggtttcattattatgtgttcaacaacaatcctcagttcattaaataaggtccgacaatatgggtttcttcgagacgaatatcgaagggtaagaaatctatagtatataaaaggttggagcaaacttccttgaccactaaaaagcataaaaactgtcgcaggcatcaggaatatttcattgcaagcaatgaatttcagaatattttgttgattagcacttaatttgtccaagacagatctcagcagaggtaaactatttgagccccttgcgtcaaggacctttttcgtatatgtggcagcatgaagcaaagagaataacaagactgggaagatactcattgtaactggataggaatttacaaagatgagtgaatacaacaggtagtggcag

SEQ ID NO: 8773 - DNA, 450 bp, Homo sapiens
ctgtgttgtcgggcatggacgcctggtcagtgttccgctccttcttgaagacgatgttgccgagctgaagaacccctgagatgacccgcagcaggcccatttgctcctcttctgggatgcccataatcctcatggcctccatggtctcctggaacatgtccttgtcctgctgcccggggatggtgacgtgtccattggacaggaagcggtatttgttgtacggctccaacaggagatcggtcttcaggtgctctccagccccagacaggagataatagaagatgtggaaggtccgttcttccttggcttggcggatagcacgagatttctccaaaagataagtctcaatgttggctccaacaatgtagccattgacatcaaagttgatgcgaatgaatttgccgaagcgggaggagttgtcattcttcacggtcttggcgttcccgaagg

SEQ ID NO: 8774 - DNA, 601 bp, Homo sapiens
catcggtgctgaaattgagcattttaaatagtacagtaggctggtatacattagggaatggactgcactggaggcaaatagaaaactaaagaaattagataggctggaaatgcttactttctgctctcattttctttcattttgtctgctgtctttttgaatgccaatactttcatttaaaatgttttgggagcacggcaacccaaaatgactgaacggtggtccaaaaatccaaaccaactgataattacttctcgaggtgataggaaaggcacaggaagttaggactttggctgaaatgatgaaaacacatgttcgccattttagggatcagcgcctcgactcctgccacctccggctccaacgatgatcatgtttggatgtatttattgaattgtcctttgctgatgaggaatttttaaagtatttcatagaataagtcctttggtatgcagatgctacatggaaggaaagaaagaaaaaaagaaaacacacaatattacttgctccataccctaaactgccgataccacagccgtaaaatgaagggtctagtagttgttatagcacggtagtccattctttctaaaggaccacttac

SEQ ID NO: 8775 - DNA, 462 bp, Homo sapiens
gtcggagtggtctctggtagaacccaaggacttctgggtactgagaagcagcagcagaatgaggccaaatgcagagatgaggctaaggcaagaatatgccccaactaaagcatagattccccaaagtgaggctcatggtgggaggccactcaccttcctagctgctgctcgaaaaggttttgactgtgttggggtgggggttgggtaagggaatggtcaagactgagaaaggaatgaaatccattcaggaaatatcgacagggctacacgtgatgtccccaaactgctgctattgaagaacttcccaaaacttctttacaaagccctaaaggaaagtttgcatctatgaaaagccaataggctgagacatccaattgctgcatggaaattgatgtacattcaggggacggcaaaaatagctgtaaaatagtgaaaaagagcagtggttgtgctcttttctgg

SEQ ID NO: 8776 - DNA, 549 bp, Homo sapiens
  misc_feature (1)...(549): n = g, a, c or t
ccactaaagcatagtacgtagatgtcagtgagacagcatgagagccagcagtcatcaaagcgttccacgtttgaagttagcaactgcttaaagttatgccctattaaaattgctttctcaaaagtttgggttagtttcaaatgtgatattttggagggaaggtaaagtaggtatctttcaggtcgtgataatgagctcctatgaaaggatgcaatataatgacccgcttttctagaaagttcataatcagctctggaacaagcacacttgattcctcactgtgcttcagaatgagattaagatcagatgttggaacgtgctatgctgtagcgtgtctggaaacaaagtacacaaacctggctacggtgatgagttagcttctgcttactacctgtgacaacccaagtgggtgacactagtgaaccttctccagtctgcaggctggcatagaaggctcttagattatattgggcagcttgcaatctgccgaagcagtgacttgcatttccacacttggcttgagcactcaacccanaaggcgaagatagc

SEQ ID NO: 8777 - DNA, 408 bp, Homo sapiens
gtaggactttaatcgttgaacaaacgaacctttaatagcggctgcaccatcgggatgtcctgatccaacatcgaggtcgtaaaccctattgttgatatggactctagaataggattgcgctgttatccctagggtaacttgttccgttggtcaagttattggatcaattgagtatagtagttcgctttgactggtgaagtcttagcatgtactgctcggaggttgggttctgctccgaggtcgccccaaccgaaatttttaatgcaggtttggtagtttaggacctgtgggtttgttaggtactgtttgcattaataaattaaagctccatagggtcttctcgtcttgctgtgtcatgcccgcctcttcacgggcaggtcaatttcactggttaaaagtaagagacag

SEQ ID NO: 8778 - DNA, 382 bp, Homo sapiens
  misc_feature (1)...(382): n = g, a, c or t
cctctctcacctctcctactcacttaaagcccgcctgacagaaaccacggccacatttggttctaagaaaccctctgtcattcgctcccacattctgatgagcaaccgcttccctatttatttatttatttgtttgtttgttttattcattggtctaatttattcaaagggggcaagaagtagcagtgtctgtaaaagagcctagtttttaatanctatggaatcaattcaattnggactggtgtgctctctttaaatcaagtcctttaattaagactgaaaatatataagctcagattatttaaatgggaatatttataaatgagcaaatatcatactgttcaatggttctgaaataaacttcactgaagtaaaaaaaaaa

SEQ ID NO: 8779 - DNA, 483 bp, Homo sapiens
  misc_feature (1)...(483): n = g, a, c or t
ttttttttttttttttttttttgtacaaaaatatatttatttggngtaatagttacaaaatattcatttccacaataatattttagcaatgcattggaatgttaaaaaaaattctttgtattaatgattcttgcaaagaccctcaaaacatcccaggggtanaactgnggttcaagaggaaaagcaatttccccaagtctctgtatctaaaaaacactagtaccatgaaanataaacttaaaacatcaataacttaaataanaattaacattacttaaggcataatgtttcacatcaacaaacaaaattcattataataaaataaaacaaggngtctggggaaagctaggggaaaataagttagctgcanattcttgggttgtggagtgagtgttcaagtcttcggagtttgggtttgcttgtccaggtggtccatggaatcctgaacccacttctgcttggggtcagcacanatctccttgg

SEQ ID NO: 8780 - DNA, 369 bp, Homo sapiens
ccactgttgctgagaagagatgggtgatgggttcatatctaaatattaatcaagcctgatttcttgctctcaaattaaactgaggttacttgcctatttggtgcaatatcatcaccctaccacgtgataagcaacaaagtttaaatttatacgctaataatgccaaaagaaaatgttgataatttttatgtattagtggaaatcttttcaaccaattctggtcacttattttgggcaaattatatatatgtgtgtttgtgcattcatatgcaggctaacattcttgcattttcatgttttgcattttaagagactagttggaaaatgctgacctgacctagattttctgaatgataaatgctgccccac

SEQ ID NO: 8781 - DNA, 205 bp, Homo sapiens
  misc_feature (1)...(205): n = g, a, c or t
cttttttttttttttttttttttttttttttggaaaatttgcttttatttacacgtttgagtnaattanatgcatgttttntttttgaggagngnttagcaaaatgcnttaaaattttaaaatngcanttaaatntacaaaaatntagcttacaaaaaactgcnaatgtttaaaaatattctgctgcaaaatttttagngtncaa

SEQ ID NO: 8782 - DNA, 606 bp, Homo sapiens
  misc_feature (1)...(606): n = g, a, c or t
ctgtcccggttatgccggaatcgttgcaggtgagtccatcagaaacaggagctgacaacctgctgggcacccgaagaccaagccccctgccagctcaccgtgcccagcctcctgcatcccctcgaagagcctggccttgctatggatgcgcttaatcaccatggaggccagcaatacccatctcagcatggctttgatattctctacttcctggcctttaaaaatgacctataatttttcagtttgctttactatattttataaagaaaattctatcttatggttgattgagcattgagacttatgaaggcattaggatagatagctcaggaatgtaaaggttcagaaaaggtctgttttctcagattaacaaatatgatggattccatggctgaccttggtgcttaaaccaggaggtttcaatctagtcctagagttgtgtccctctgaaaggcccaatgccatgtaactaactttaaactggatatatactttgagccttacttaattcacagataagttgacttaactcagtatttttatttcaattaatgaaaacagtcctcttttcaaccccaggttgcttacattttgctggnctcccca

SEQ ID NO: 8783 - DNA, 264 bp, Homo sapiens
agaagcagttgcctgccaaattgaagactacctttcaaatagcaaaagagagagagaaggctgatatttcggcttttaaataaagatttgtgtggttctgcttttactgtaactgtcactttcccagtgaaaatgatttcatatacattgagggtcttacaggtatgggtaaagttctataaattgcaacaaaatgatacccaatttcattttatcctttttgtattgtgaaactggaaactttatgacattgtaaattatcag

SEQ ID NO: 8784 - DNA, 706 bp, Homo sapiens
  misc_feature (1)...(706): n = g, a, c or t
ncgacncactanagggcgaattgggccctctagatgcatgctcgagcggccgcccgggcaggtagaaattctatgtggtttcctaatgaagtttctagcagttgtgatgtcttcaaattctcatttaagattttatttagagttaagtcacatgagagatactttcaatgttgtcatctcaatacaaacctgcatacggcatttcactaaatccaggggaaccacagcagtgtgtgtcagaccacaacttaagaccccaccaaagccacacagtgcataatacttcgcggagccaaattcacaactgtactctgtagtaagagaagacacaccatgcattttaatataaaactcatgttactggtcataaacttacctcctggacagttaggtttccacacagcttgttagatgactatatcttataacttaacagtcagtcatgcttcaatatgctctagtccagcatgcaaaacaaacctgcattctgcatttaaccagatctagaggaaccaatgctgtatgtgttgtgccacagctaataattcctccaagtccacaaaggataaagaatctgccagatccatagtcacagctatactgctctgtttgattggaaaaaaaaaaatcaagtaagtatttcttcagagatgactaaggccactggaatgaaagnaaatgtttccctgngagatactattatcac

SEQ ID NO: 8785 - DNA, 536 bp, Homo sapiens
ctgcaacacatgctaaggcacttttattatataaaaaagggggtagggtgggagtttcactcactcctttgtgacagcaactgggacctgaattcagagctttgtaggcatatgcagcttttatatcacttcatgatttgagagtttgtttcctttaaaaaaaaaaaatgccttcttgccgtaagtctcaatgcagcatatacaaaacagttaggaatacaagtaaattcggcaaccagtgtagaccagtgaggacgagctactctcttctaaacaaaggcagtgagaaagactcggaattttatcatttattacaagaaaggggaaaaaagaaaaccttattttgctttcaaaaatacctgtgcaggtggcagatttttaaactatactgagtcaacggtgcaggtaaaccaccctcgggcccagtcctagagtagacacaagatcgcctgggagggccgctggcccctctaacgctctggctgtcagacttgggacaagtcccttaaccattaaatatatttggtcccccaaga

SEQ ID NO: 8786 - DNA, 604 bp, Homo sapiens
  misc_feature (1)...(604): n = g, a, c or t
ccactgtgtagcaccttctaattcaatttcatcggcagttgtaataacagttccagcctcaggtgttttaatggtgggaaacatcttgattgcttctccagaaacttgaccatcggttttgttttggaaatcttggagaatctcagttccttccacagcaataagttctgtgggagaagcttccatttcttctaataactcaggtttaccatcatcttctgaaggttctaattttgtgtcaggagataaagagggaggctcagttatgtgaaggtattcctcacttgatggtttgaaagtcgcttcaatatttacatgaatttccttaaaagaatcctgtggggacattacagatgagccgacgtctattcctggcagagcactgggctgggggatctctgtgtgtccagaggcttcactgcctgagtagatagtgaggggagatgatggtgtctgagaagacaacttcgcaaatgttgaaactgctaatgttgtatcagtgtaatatgggggattggatccttccatcacatcaggcacctctgttacactctgatccataaggngggtagtagcaatacttagatagggagtatggtctact

SEQ ID NO: 8787 - DNA, 356 bp, Homo sapiens
ctgctgaggactcgatagcggtgccgcttgcctgccaatttgcccttgacgatctgggagccagagagaggcacatgccgcccattgaagctacagagagaaacagggagggcagaggcttaagtggaacaggagagggaaggttttttgattttttttttgtttttttttgagagagtcttgctctgttgcctaggctggagtgcagtggcatgatctcggctcactgcaatgtccacctcctgggttcaagcgattctcctgcctcagcctctcaagtagctgggattacaggcacctgccaccacgcccagccaatttttgtatttttagtagagacaatttcactatgttgg

SEQ ID NO: 8788 - DNA, 281 bp, Homo sapiens
  misc_feature (1)...(281): n = g, a, c or t
tttttttttttttttttttttttnganattcatattttatttacaagtaaatgaanactgtccctgtaaactctaatttgggatntgaanaacaatntaaanaagtagttgctggtgccacagtgatgtgtgaaggagtntatgccactgtttntttaaacagngattttgttattaaaaaaaaaacccacctacncnatttcttcatgtngcatatgtaaaataattaaaaataaaagngacttttnaaaactntacagtctgngatcaaatgcgtgagg

SEQ ID NO: 8789 - DNA, 580 bp, Homo sapiens
gggagtacacagaactctactttctgctcaatttttctgaaaatctagaattgctcttaaaagagctcttgagtatctatctaggagtggaactgctggatacagataatgcaaaccagttttctatatagttatgtaagaatctgaggctggacacagtgcctcacacctgtcattccagcactttggaaggcagaggcaggaggatcacttgagcccagaagtttgagattagcctgggaaacatggggagaccccaactctacaaaaatagtaaaatattagctgagcatggtggtgtgtgcctgttgtctgagctacttgggaggctgaggtggggaggatcgcttgagcctaggaggtcaaggttaccgtgagctatgattgtgtcactacagcctgtgtgacacagcaagaccctgtctcataaacaaacaaataaactaattaaggaaggagatatagtgaagaggacaggagccattgtggacgttccagttggtgaggagctgttgggtcgtgtagttgatgcccttggtaatgctattgatggaaagggtccaattggttccaagacgcg

SEQ ID NO: 8790 - DNA, 601 bp, Homo sapiens
ccaaaattttaaattacaacagattgttcaatttgatggatctctcagtaaacttcagtttgaaacaacaaaaaaatactgtttactaaaacataaaaaatgtttccaagaaattatcatccaatttgaaaaataaaaaatgtaacccatagtaagtaagaaaaatacaagagaaaatcaaactttgttggaatcaagagaataccatgaacttaaaaacttcctaaatcagtagcatatcctgtattaccatgtgtagaaaactgtaattaattaatgtaaggtagtttttattagttgcataacctaaaaatacaaggaaattttggaatatacctctaaaaagaccacgaaattgtcactgaaatacacatttcttgagacaatgggcaaacttcccatttatgggaaatatcttctttttttcacacagtgaaacagagaaaaattatatcaaatgagaaatatttttctctaaaataatcttcttaaatacctcaataatgcaatacttgggaaatgtaaattttcaaaactcagacttgaaataggttattattaaacaaatatacataaatcttattgcttggcacgatttttc

SEQ ID NO: 8791 - DNA, 601 bp, Homo sapiens
  misc_feature (1)...(601): n = g, a, c or t
ccattctaaagttggtgagtttgtcaagcaactatcgacttgatcagttcagccaagcaactgacaaatcaaaaacccacttgtcagttcagtaaaataatttggtcaaacaacagtctattgcattgatttataaatagttgtcagttcacatagcaatttaatcaagtaatcattaattagttaccccctatatataaatatatgtaatcaatttcttcaaatagcttgcttacatgataatcaattagccaaccatgagtcatttagaatagtgataaatagaatacacagaatagtgatgaaattcaatttaaaaaatcacgttagcctccaaaccatttaattcaaatgaacccatcaactggatgccaactctggcgaatgtaggacctctgagtggctgtataattgttaattcaaatgaaattcatttaaacagttgacaaactgtcattcaacaattagctccaggaaataacagttatttcatcataaaacagtcccttcaaacacacaattgttctgctgaagagttgtcatcancaatccaatgctcacctattcagttgctctgtggtcagtgtggctgcataacagt

SEQ ID NO: 8792 - DNA, 545 bp, Homo sapiens
  misc_feature (1)...(545): n = g, a, c or t
ctctgataaaacagactttaaaccaacaaagatcaaaagagacaaagaaggccattacataatggtaaagggatcaattcaacaagaagagctaagtatcctaaatatatatgcacccaatacaggagcacccagattcataaagcaagtccttagtgacctacaaagagacttagactcccacaaaataataatgggagactttaacaccccactgtcaacattagacagatcaacgagactgaaagtcaacaaggatacccaggaattgaactcagctctgcaccaagtggacctaataaacatctacagaactctccaccccaaataaagaggatatacatttttttcagcacaccacacctattccaaaattgaccacatatttggaaataaagcactcctcagcaaatgtaaaagaacagaaattataacaaactgnctctcagaccacagtgcaatcaaactagaactcaggattaagaaactcactcaaaactgntcaactacatggaaactgaacaacctgcttcctaagtgactac

SEQ ID NO: 8793 - DNA, 603 bp, Homo sapiens
  misc_feature (1)...(603): n = g, a, c or t
cctggttctggaatcctcagttcaaggttatcctacgcagagagccaggtaccaatgggtgcgctgcaatccagacagtaattctgcaaactgccttgaagaaaaaggaccaatgttcgaactacttccaggtgaatccaacaagatcccccgtctgaggactgacctttttccaaagacgagaatccaggacttgaatcgtatcttcccactttctgaggactactctggatcaggcttcggctccggctccggctctggatcaggatctgggagtggcttcctaacggaaatggaacaggattaccaactagtagacgaaagtgatgctttccatgacaaccttaggtctcttgacaggaatctgccctcagacagccaggacttgggtcaacatggattagaagaggattttatgttataaaagaggattttcccaccttgacaccaggcaatgtagttagcatattttatgtaccatggntatatgattaatcttgggacaaagaattttatagaaatttttaaacatctgaaaaagaagcttaagttttatcatccttttttttctcatgaattcttaaaggattatgctttaatgct

SEQ ID NO: 8794 - DNA, 360 bp, Homo sapiens
cgcaatgcctatgtctggagtcagaaagatggtgtttggaagccaaccctggtgatcctgagaattaatcgcgcagctacttttgtgaagtggtcccccctagagaacaaatttgctgtgggaagtggagcacgactcatttctgtttgttactttgagtctgaaaatgactggtgggtgagcaagcacattaaaaagccgattcgctccacagtcctcagcttggattggcatcccaacaacgttttgctggcagcaggatcatgtgacttcaaatgcagagtgttttctgcctacattaaagaagtggatgaaaagccagccagcacgccctggggcagcaagatgccttttgggcag

SEQ ID NO: 8795 - DNA, 447 bp, Homo sapiens
  misc_feature (1)...(447): n = g, a, c or t
gtccaggggnaattgagggaggctctaagctaggggcactgcatggtgggacaggatggccccttgaggactgaaccctggggagaagacaaacagtaataataaaaacaaataacaagtactttaagaatggattgtatgacctatagtgacagatgacatcactaatactgaaagctttttatattaataattttggcaaaatgtcattttgtaatatagtatatgctttccaggtgtgggggtggtaaagtaatgaggccaaaatcatcctgccccaagactaatatcttctaatggtgcattagcaaggaaggcagaaatcaatatttagatatcagtagagtacataatactgtagaaagaagaagagcacacatgagacagagaaggaggtggatgctcctgggttgagagcaaggggtgggggtgtggaagggactaggc

SEQ ID NO: 8796 - DNA, 422 bp, Homo sapiens
  misc_feature (1)...(422): n = g, a, c or t
ttttttttttttttttttagctgccatcttgcgtccccgcgtgtgtgcgcctaatctcaggtggtccacccgagaccccttgagcaccaaccctagtcccccgcgcggccccttattcgctccgacaagatgaaagaaacaatcatgaaccaggaaaaactcgccaaactgcaggcacaagtgcgcattggtgggaaaggaactgctcgcagaaagaagaaggnggttcatagaacagccacagcagatgacaaaaaacttcanttctccttaaagaagttaggggtaaacaatatctctggtattgaagaggtgaatatgtttacaaaccaaggaacagngatccactttaacaaccctaaagttcaggcatctctggcagcgaacactttcaccattacaggccatgctgagacaaagca

SEQ ID NO: 8797 - DNA, 202 bp, Homo sapiens
  misc_feature (1)...(202): n = g, a, c or t
gattaatnttgggacaaanaattttatagaaatttttaaacatctgaaaaagaagcttaagttttatcatcctttttttctcatgaattcttaaaggattatgctttaatgctgttatctatcttattgttcttgaaaatacctgcattttttggtatcatgttcnaccaacatcattatgaaattaattagattcccatgg

SEQ ID NO: 8798 - DNA, 576 bp, Homo sapiens
ctgtatgatttcagcagccaaagctggatgatggactgaaacattactatacaactgggacaaaacatatacaatatcacaatactaagcaaaaacgctttacacccaaagaaataaaacaggttacaaaatgtggagaatttagcaggcaaaactgtattacaagcaacattttaaatcatcatttttaatccattgcaactatttaaaacatctaaaacaaatataaaaatgagccttttagtattttactgacgtgatttttttgtctttaaatatttgttaaagcttgatgttatactcaaagtacatattatatagctaaaatgtcaagtgagaagagtgtatacaaagtggtccaagttttatttcaaactctgatttccaattaacccttctaagtattattctttaagttatagtttcatccatggtgaaaaagatttagaaggttgcctaaaattttcacatctatgtctttgagtaaataattagaccatgttgaaaattcccaggtctagtaaatcaggtttaaaatattctgaacttgtagaaataccaactggtaacagttgg

SEQ ID NO: 8799 - DNA, 374 bp, Homo sapiens
  misc_feature (1)...(374): n = g, a, c or t
tttttttttttttttttttttttttngattnaaaanattttattttctttatgcaggtaggcagttanaaatttcaaagtctaacaatgacattcttgaagngggcacagccttttaaactcaggctatgtntacagtaaccttgnggaactggttcanccanatcttnactttcatgaaagcncagggtctgtccttttntttccanagggctcctntcatattccatcgccagtttntgttacaaggcanactgaatcaagccaanatcaacacacactggtacacgtggntcccaaccaattttatatgtatatatatattctacttccaacacccgcattcatcctggttcaatcaaagcctggttttgg

SEQ ID NO: 8800 - DNA, 434 bp, Homo sapiens
ccacggccaaggaggatgctggcctggaaggggacttcagaagctacggggcagcagaccactatgggcctgaccccactaaggcccggcctgcatcctcatttgcccacatccccaactacagcaacttctcctctcaggccatcaaccctggcttccttgatagtggcaccatcaggggtgtgtcagggattggggtgaccctgttcattgccctgtatgactatgaggctcgaactgaggatgacctcaccttcaccaagggcgagaagttccacatcctgaacaatactgaaggtgactggtgggaggctcggtctctcagctccggaaaaactggctacattcccagcaactacgtggcccctgttgactcaatccaagctgaagagtggtactttggaaagattgggagaaaggatgcagagaggcag

SEQ ID NO: 8801 - DNA, 607 bp, Homo sapiens
  misc_feature (1)...(607): n = g, a, c or t
ggggaccgagtctttgtccactacactggctggctattagatggcacaaagtttgactccagtctggatcgcaaggacaaattctcctttgacctgggaaaaggggaggtcatcaaggcttgggacattgccatagccaccatgaaggtgggggaggtgtgccacatcacctgcaaaccagaatatgcctacggttcagcaggcagtcctccaaagattccccccaatgccacgcttgtatttgaggtggagttgtttgagtttaagggagaagatctgacggaagaggaagatggcggaatcattcgcagaatacagactcgcggtgaaggctatgctaagcccaatgagggtgctatcgtggaggttgcactggaagggtactacaaggacaagctctttgaccagcgggagctccgctttgagattggcgagggggagaacctggatctgccttatggtctggagagggccattcagcgcatggagaaaggagaacattccatcgtgtacctcaagcctanctatgcttttggcagtgttgggaaggaaaagttccaaatcccaccaaatgctgagctgaaatatgaattacacctcaagagtt

SEQ ID NO: 8802 - DNA, 414 bp, Homo sapiens
  misc_feature (1)...(414): n = g, a, c or t
aatgaangtgnacatctattnctnagggagtgtgnaggcacanaaactgttattngggcattctacgganggagatatnnttgancttgttgatggtcactttgataccaagattggacacaaagtagagagtgaaagttacngaaagattgcagacagcattgggtgctcaaccaacaacattttgtttctgacagatgttactcnagaggccagtgctgctgaggaagcagatgtgcacgtagctgtggtggtgagaccaggcaacgcaggattaacagatgatgagaagacttactacagnctcatcacatncttcagtgaactatacctgccttnctcaacctagagannggttgttaaggcagaccgccctgttccccanagttgtccctgtngtgtctaggtttattc

SEQ ID NO: 8803 - DNA, 504 bp, Homo sapiens
  misc_feature (1)...(504): n = g, a, c or t
gattgtancnatgttggtgtatctcgtgtacaagatggaaaagtgcttttgttgttctacctgatccagttgggggagcaggaatagggggtgcctgcctaacggcctctagcccatgtgcttatactgggatctgtcccgagggatctgcacctggttggcagtcattttgtggtggacgtggtaaatcgcgagtgttaccatgatgacgaggcccaagatgagccccaaaatcaggggcaaggtttcttccagttgcccccgctcatccactgggcatttatgctcttcactgaagacaaaatctgagataatgtcaaaaggttggatgtggaccgcagacaggatcatggtgaccgtcttctgcggatcactagaggccagtgaaatggtttgttgagcttgacactcataggacttcccagcgggggtgaccaaggcagagaggtggtgcgagttggctgtgtgcttcccagcactgactgcgtnttttgaagtgggttt

SEQ ID NO: 8804 - DNA, 205 bp, Homo sapiens
  misc_feature (1)...(205): n = g, a, c or t
atggngattgatgaggagcttctgggagatggacacagctatagtcctagagctattcattcatggctgaccagggccatgtacagccggcgctcgaagatgaaccctttgtggaacaccatggtcatcggaggctatgctgatggagagagcttcctcggttatgtggacatgcttggtgtagcctatgaagccccttcgctgg

SEQ ID NO: 8805 - DNA, 525 bp, Homo sapiens
  misc_feature (1)...(525): n = g, a, c or t
ccaattatttccaattnntattttattcttaaaacttaagcatggtaaaatgttaagctgttttcatccactgatattattctactataaaaagcccttcttgagcagatttgatgataaaaaggagaacatttctaaggtataattagagaagctgttgcatgagaaatcatgtctccatctccattttgctatgcgttatctgaggattgtttctgaaagagatctatttaggcagtgtatgtatgtgtcagcatgtaaaaagtaaagaactgaaaatagacaaaccttgtaaatgcacttcaaaaccaattgtggctcaagtgtaggtggttccccaaggctggtaccaatgagactggggtttgggaattagttggtcatcatccctcctgctgcccagcagtggtcagtcatttttcatgagggatggactaggaaaatgaagtgtctattataaggagagttcctgtaacttaaggagcaagctcactacaaaacccagctacctgcttatcgtagtgg

SEQ ID NO: 8806 - DNA, 399 bp, Homo sapiens
  misc_feature (1)...(399): n = g, a, c or t
cgccgccatgtccgacancgagaagctcaacctggactcgatcatcgggcgcctgctggaaggtgacatacacggccagtactacgaccttctgcgactatttgagtatggcggtttccctcccgagagcaactacctctttctgggggactatgtggacaggggcaagcagtccttggagaccatctgcctgctgctggcctataagatcaagtaccccgagaacttcttcctgctccgtgggaaccacgagtgtgccagcatcaaccgcatctatggtttctacgatgagtgcaagagacgctacaacatcaaactgtggaaaaccttcactgactgcttcaactgcctgcccatcgcggccatagtggacgaaaagatcttctgctgccacggagg

SEQ ID NO: 8807 - DNA, 603 bp, Homo sapiens
  misc_feature (1)...(603): n = g, a, c or t
ctgaaagatgagtttnttaaacttctgcagatttcactgtggggaaataagtgtgatctgtctctctcaggtggagaaagtagttctcagaataccaatgtactaaattcattggaagacctaaaacctttcattttattgaatgatatggaacatctttggtcattgcttagcaattgcaagaaaacaagagaaaaagcttctgctactagagtgtatattgttctcgataattctggatttgagcttgttacagatttaatattagccgacttcttgttgtcctctgaactggctactgaggttcatttttatggaaaaacaattccatggtttgtttctgatactactatacatgattttaattggttaattgaacaggtaaaacacagtaatcataagtggatgtccaagtgtggggctgactgggaagagtatattaaaatgggtaaatgggtttaccataatcatatattttggactctgcctcatgagtactgtgcaatgcctcaggttgcacctgacttatatgctgaactacannaaggcacatttaattttattcaagggtgatttgaattacaggaagttgacaggtgacag

SEQ ID NO: 8808 - DNA, 608 bp, Homo sapiens
  misc_feature (1)...(608): n = g, a, c or t
cctttggtcagagtnncagttggataaaccatgtgatttaatgtgaacatctgtttttgctctggaaggaggctggagtgagtagctcaatcagtctagagggtgctaaatgcttaggtaagggactctgataaaacttctggacacccaagctcagaggaactactctagtggacagcactttgcatgtgctgtcattcatcatttaggggaaaattaagtgtgtcctagtgtcattacactggaaagagacactaagaaatgtatgtctggcttctatttgccccatctgccatttccctttgcccttttgatctgtatcttttccctgaatgaacagtatccataaataccacaggctttctgagtcctctgagtttttctagtgaattgccaaaaccaaggattgttttggagtaaaacaaaactcaaacaaggctgttatgagaattaaatacaacagtgcatttaagatagtgcctggtatatgatacaaattcaatcaatttttgtagttatagttaccttaagccccttacatgttgcatgtntaaaactaacacaattgatagtcactctatttatttatctgngaactgnctttcttc

SEQ ID NO: 8809 - DNA, 330 bp, Homo sapiens
  misc_feature (1)...(330): n = g, a, c or t
ctgcatcccatgtgcgtcnatgggcaaagtatttgtagcactgcccttggaatttgtgccagccatagtcacatgtctcggtatcttgctcacaaagtgcaccaacataacttggaaggcagaggcacctgaatgtgttaaaaccatcaacacaagtggctccattacgacagggattagagtgacattcatcaaaatcaagttcacactggtctccgctgtatcctggcacacaggtgcatacgtaggaagtttcagtaggataacaggtgcctccgttaaggcacgggttcattttgcagcgatcaggtcctggtaaatagattgccg

SEQ ID NO: 8810 - DNA, 347 bp, Homo sapiens
cccgaagatgataccatccctgatgaggaacattttattgacatagaagatacaccaggatatcagactgccttctcacagttggcatttgctgggaaaaaagagcatgatcctgtaggtcaaatggtgaataaccccaaaattcacctggcacagtcacttcacaagttgtctaccgcctgtccaggaagggttccatcaatggtgagcaccagcctgaatgcagaagcgctccagtatctccaagggtaccttcaggcagccagtgtgacactgctttaaactgcatttttctaatgggctaaacccagatggtttcctaggaaatcacaggcttctgagcacag

SEQ ID NO: 8811 - DNA, 491 bp, Homo sapiens
  misc_feature (1)...(491): n = g, a, c or t
ggccagcctcagcctcccnaagtgctgggattacacgtgtgagtcaccacgccaggcaaggcatggatgttttccaaaaactccctaggggatcttgatatttatctaggtctggtctgaatcatatgatatgctttataactattatctacccatacatgtgtacatttctatccttcctatgttttttaaactgaggtataaattagataatgtacacatgttgatgaattttgatctaggtatacactgtgtacctatcacccagattaaaatatagaacgtttctcttccccaaaggtcattgctatcctgttaccaccttcagttttgcacgttcttgaacttcaggccagtgctgctgtggatgccagtggtttttttttcactgctgagctgtattctgttgtgtggatataccacaattttattatccatcctctgttgacagggttngtttccagtctttcactactgcaaataatgctgct

SEQ ID NO: 8812 - DNA, 617 bp, Homo sapiens
  misc_feature (1)...(617): n = g, a, c or t
atttgttatcagtgtacnnnctaattgagagcattncagtagtatcaaacaataatgtctactgtttatagtccacttaataaaaatagaggcatttactatttgccttaggctgataggaatgtgggttttcttgaccaaatatatcagcatctaattgaaatgaccaaatagcattcttagacttctgtattatgaatataattgatatttaaattaatgtcttgttcacatatgtgtactttcatatttgattttaaaatgtacattataacctgtatggtattttatttaaaggagataaacagccaaatagcaaataggtcactgaatgataagatttgcaccttagaacaataatcattttaaggataacaagtaaatgtctgaaagcatgaggggctttatttgcctttacctcatatgagtctttgatcttgaaccgatacttttggatctcattgttgatatacctgaatttactttgtaagagattttaacttcacttcatgctgatgatgtatcaaattcattttatagaaagatttaaagtttttttctggaagtgatatatgtcaaattncatttcctactgcagtatttgagcagggacagtc

SEQ ID NO: 8813 - DNA, 444 bp, Homo sapiens
  misc_feature (1)...(444): n = g, a, c or t
ccagttttgaggatcagangaagaaaggcttcctctgtgacattactttaatcgtggagaatgtacatttccgggcccacaaagccttacttgctgccagtagtgaatacttctcaatgatgtttgcagaagagggggaaatcggccaatccatttatatgctggaaggcatggttgcagacacctttggtatcctgctggaatttatctacacaggttatctccatgccagtgagaaaagtacagaacaaatcctggctactgctcagttcttaaaagtctatgacctggtaaaggcttacacagacttccaaaataatcatagctccccaaagccaacaactttgaacactgctggtgccccagtggttgttatctctaataagaaaaacgatcctccaaagcggaaacggggaagaccaaaaaaagtcaatacattgcagg

SEQ ID NO: 8814 - DNA, 618 bp, Homo sapiens
  misc_feature (1)...(618): n = g, a, c or t
ccacctggagacggnnattttgggcctattgaagacacctgctcagtatgacgcttctgagctaaaagcttccatgaaggggctgggaaccgacgaggactctctcattgagatcatctgctccagaaccaaccaggagctgcaggaaattaacagagtctacaaggaaatgtacaagactgatctggagaaggacattatttcggacacatctggtgacttccgcaagctgatggttgccctggcaaagggtagaagagcagaggatggctctgtcattgattatgaactgattgaccaagatgctcgggatctctatgacgctggagtgaagaggaaaggaactgatgttcccaagtggatcagcatcatgaccgagcggagcgtgccccacctccagaaagtatttgataggtacaagagttacagcccttatgacatgttggaaagcatcaggaaagaggttaaaggagacctggaaaatgctttcctgaacctggttcagtgcattcagaacaagcccctgtattttgctgatcggctgtatgactccatgaagggcaaggggacgcgagataaggtcctgatcagaatcatggtctcccgcagtgaagtgga

SEQ ID NO: 8815 - DNA, 613 bp, Homo sapiens
  misc_feature (1)...(613): n = g, a, c or t
ctgctcttgaaggacagngacttgttaccaccacaacagcagagcctgccatccccaacagatcaccagttgtccctgacatcgtgccctaccttgtctccctttgtggtctcctaaatgcccatctcgttggccttggttcggctagtggtatggaggggtgctgcctagcactgacctgagagtgtgtgtgacccactgacccaatggtgagaactgactgcccacctctccaactgattgttcaaagggtagaggagacaaagtgcagatctcaccctttcttggtattttcccttctacccttttggaagatagagtggctatttgaagttaaaggaaagggaaggggcacagaaacagtattacttggtgtgtttgtgtagtgggttttcttggggagggagaggagagttaagtactttaaaggatagaaagaaaataatgagacaagagagtttaggtgtgcttgggaactgtcttaggtaatgatcctggaagaggccagcttgtactggaacccagatatgcttaggagtcaaccttgacattgaagtcatttgcatttctttcctactggctaccagancctctcagtcatcatactgagact

SEQ ID NO: 8816 - DNA, 351 bp, Homo sapiens
  misc_feature (1)...(351): n = g, a, c or t
gtctttaaaccctgcgtngcaatccctgacgcaccgccgtgatgcccagggaagacagggcgacctggaagtccaactacttccttaagatcatccaactattggatgattatccgaaatgtttcattgtgggagcagacaatgtgggctccaagcagatgcagcagatccgcatgtcccttcgcgggaaggctgtggtgctgatgggcaagaacaccatgatgcgcaaggccatccgagggcacctggaaaacaacccagctctggagaaactgctgcctcatatccgggggaatgtgggctttgtgttcaccaaggaggacctcactgagatcagggacatgttgctgg

SEQ ID NO: 8817 - DNA, 385 bp, Homo sapiens
  misc_feature (1)...(385): n = g, a, c or t
cctcgtgcttcgccngcgcctcgtgcagcagcagcaggttgccctcgctcacagctctggttacttccgcaaactgcatcaggtgatactttttcaggagctccacagtgggcatgtgacccaatagcatttttactggaagcaaatagatcagaatcatccttttgttcttctgactagaacggtgacaatgctcaaaggcaaatgacaggtactcctcagcttgcttaaaatcgctgtcaaacatagccttgcgtccaacgtagtatttgtatgttactctctgtgcagtgctgtaatcgtctttcaggtttgagctgtcaattgctctaattaggggtttacataaatggagtttgttgatcttgaagtagattttaaacag

SEQ ID NO: 8818 - DNA, 575 bp, Homo sapiens
  misc_feature (1)...(575): n = g, a, c or t
ggctgaggcaggagaanngcgtgaacccgggaggtggaggttgcagtgagccgagattgcgccactgcactccagcctgggcgacagagcgagactgtctcaaaaaaaaaaaaaaaaaaaaaaaagaacggaatgtactgganatgtatttgataaccaaggttttaggtaaattttcaccagtattagttctatttgcaaactgaaaaatgttgtaggcttaatataaaataaccacattagtgaacattatatctcttanaanaaaggccatattttgctcctgcttctgtaaaaatattatttgtttgaaggggaaataatggtagtgtgacctttcacttaattcctactcccttaatgtgagagagacaaaatgagctgaagaaggaaaattctggagttacactccacaaccttgaacatactgacggacatctctgttttgacaacgatttctccatgccacccatgctctaatgccttgtggatcacggacaaccctntttgcacaagctacagcatcagcgatgttatcttgcancaaagcactgcaggataaatgacaggcatta

SEQ ID NO: 8819 - DNA, 161 bp, Homo sapiens
  misc_feature (1)...(161): n = g, a, c or t
atcatgaaaatgggtctgttgtgcgaagtgtctgccgctgtgcctgctgtgttatttttaactgatctantggggctcggccccatgtttgaaggccaaaaacntgtcggtgttnnttttttgtttttgttttagtaatgtgtaatttatccttgataacg

SEQ ID NO: 8820 - DNA, 620 bp, Homo sapiens
  misc_feature (1)...(620): n = g, a, c or t
tccagatttttgaaaaatncaatgtctaatggttatgaagaccacatggccgaagactgcaggggtgacatcgggagaacgaatttgatcgtcaactacctccctcagaacatgacccaggatgagttacgaagcctgttcagcagcattggtgaagttgaatctgcaaaacttattcgggataaagtagcaggacacagcttgggctatggctttgtgaactacgtgaccgcgaaggatgcagagagagcgatcaacacgctgaacggcttgaggctccagtcaaaaaccattaaggtgtcgtatgctcgcccgagctcagaggtgatcaaagacgccaacttgtacatcagcgggctcccgcggaccatgacccagaaggacgtagaagacatgttctctcggtttgggcggatcatcaactcgcgggtcctcgtggatcagactacaggtttgtccagaggggttgcgtttatccggtttgacaaacggtcggaggcagaagaggcaattaccagtttcaatggtcataaacccccaggttcctctgagcccatcacagtgaagttttgcagccaaccccaaccannaacaaaaacgtggcacttcctctcgcacct

SEQ ID NO: 8821 - DNA, 571 bp, Homo sapiens
  misc_feature (1)...(571): n = g, a, c or t
ctgggcacagtggctcncacctgtaattccagcactttgggaggccaaggcgggtggatcacctgaggtcaggcattcgagaacagcctggcccacatggcgaaaccccatctctactaaaaatacaaaaattagcccggtatggaggcatgtgcctgtaatcccagctacttgggaggctgaggcaggagaatggattgaacccaggaggcagaggttgcagtgagccaagattgcaccattgcactccagcctgggcaacagaacaagactccatcnaaaaaaaaaaaaaaaaaangaangaaagaagaaaagaaaattagccaggtgtggttgcatgcacctgtagtcccagcactttgggaggccaaggcaggaggatcaatcaaggctaggagtttgagactgcagaaagaaaccctgtctctaaaaaaaaggtccaggtaatttcagggtccagctccaccacaagcgcagctccaggggctgttgagttttgcctttatcattccaagtagtccctgctccanaccaagtnccaccatctggcagtcaggtcagtccaaccaca

SEQ ID NO: 8822 - DNA, 444 bp, Homo sapiens
  misc_feature (1)...(444): n = g, a, c or t
gtttctgctcgctcaaccnnnttgtcgtgttgccctcgcttctcagatccccgccggaagtgaagagagcaagcagatttgaacctatctgctttcaagctggtcatcatgatgaaacttagacacaaaaataaaaagccaggtgaaggttccaagggccacaagaagataagttggccctaccctcagcctgcaaagcaaaatgggaagaaagcaacctccaaagtgccctccgcacctcattttgttcaccccaatgatcatgccaatcgagaggctgaattaaagaagaagtgggttgaggagatgagggagaagcagcaagccgcccgggagcaaganagacaaaaacgcaggaccattgagagctactgtcaggatgtcctaagacgccaggaggagtttgagcataangaggaagttttgcaggaattaaatatgttt

SEQ ID NO: 8823 - DNA, 525 bp, Homo sapiens
  misc_feature (1)...(525): n = g, a, c or t
ccactacgataagcaggnnnctgggttttgtagtgagcttgctccttaagttacaggaactctccttataatagacacttcattttcctagtccatccctcatgaaaaatgactgaccactgctgggcagcaggagggatgatgaccaactaattcccaaaccccagtctcattggtaccagccttggggaaccacctacacttgagccacaattggttttgaagtgcatttacaaggtttgtctattttcagttctttactttttacatgctgacacatacatacactgcctaaatagatctctttcagaaacaatcctcagataacgcatagcaaaatggagatggagacatgatttctcatgcaacagcttctctaattataccttagaaatgttctcctttttatcatcaaatctgctcaagaagggctttttatagtagaataatatcagtggatgaaaacagcttaacattttaccatgcttaagttttaagaataaaataaaaattggaaataattgg

SEQ ID NO: 8824 - DNA, 624 bp, Homo sapiens
  misc_feature (1)...(624): n = g, a, c or t
ctgaaaatcttttagtaanagctttaaagatgagcccatgaattcactttaaatttcaccagttaaattaggtcaaatggaaggaactcaaatgagtattgcccaatcagagcccattatttgtaagtcatcagtaaccttaaaactccacttagacctaattattgaaaacttgcatataatgaagtgaaagaatttccattcatcaacctctcaatcccaggttttcaaagaaaaacctatctaaggaatacttaccaaaatcagataagaaaatttaaacctgcatagttatcagatttgttccactacaaccagtctgcatacagttacacatcaattcgttctgtatacactctagaactgaacagaacaaagtttagcatagaaaagctgtaagaaacaggttcctaattacggaagttgcaaagttcaaaagggtatgaaaaaaactaatgtaaattcgatacttccttcgtttcaaagaaatagactttctgtaaaaatatatacaatttttacaaatacatttacaagctgtcttaagaattgaggatatccatattcataactaattactgagccttccgtcaagtattattggtgataaactaggctaataaa

SEQ ID NO: 8825 - DNA, 619 bp, Homo sapiens
  misc_feature (1)...(619): n = g, a, c or t
ggcgcctcctgtcacncctgtatcgggggcaccaacgtgcgtgctgaggtgcagaaactgcagatggaagctccccacatcatcgtgggtacccctggccgtgtgtttgatatgcttaaccggagatacctgtcccccaaatacatcaagatgtttgtactggatgaagctgacgaaatgttaagccgtggattcaaggaccagatctatgacatattccaaaagctcaacagcaacacccaggtagttttgctgtcagccacaatgccttctgatgtgcttgaggtgaccaagaagttcatgagggaccccattcggattcttgtcaagaaggaagagttgaccctggagggtatccgccagttctacatcaacgtggaacgagaggagtggaagctggacacactatgtgacttgtatgaaaccctgaccatcacccaggcagtcatcttcatcaacacccggaggaaggtggactggctcaccgagaagatgcatgctcgagatttcactgtatccgccatgcatggagatatggaccaaaaggaacgagacgtgattatgagggagtttcgttctggctctancanagttttgattaccactgacctgctggacc

SEQ ID NO: 8826 - DNA, 620 bp, Homo sapiens
  misc_feature (1)...(620): n = g, a, c or t
ctgctcgggaggctganncacaagaatcgcttgagccagggaggtggaggttgcagtgagctgagatcacatcattgcactccagcctgggcaacgggcgagactctgtctcaaaaaaaagaaagaaagaaaaggtacatgtatatatttgtcctgcattatgttttttacttgatataaatgtatttttactgtgatagtccaagtgccctggggggcaggtgtgctctatgtggttcttcttccattggagagctggcgtagagatctgcagtgttcacaaggatgttggtttggagatgtctgctgctaggacctggggtgtgtgactcagtccatatgagagggacatctgggtggaggagtaaattcctgtgctctgaaatgccacttggtagctctggacaatgaaggacaattgactcaagggtgcctggcttctgctgctgctgggaaaaaattcagtttatagcattcctgcacctcccaaagtagataacctggaggtcattcagttaacaactgtccctgaggactcagttttgggggaggggttatctgggagaagctttancctgttctgagccattaggagacattagtgaanttggagcactgga

SEQ ID NO: 8827 - DNA, 254 bp, Homo sapiens
  misc_feature (1)...(254): n = g, a, c or t
caagctttttttttttnnntttttttttttttngcttattaaactagttttactttancaccgttcttagtggagcaggattcttgatcatggggnggaattttgtgtatctgggcttcatgggatgcataaaattttccagttggtaagcagcaggtgccgagggtctggatcanaaaaaaaggcaggcagccgggttcccactcnccttccatgagctntccgnagctcaccggccatcacttgaagcaaac

SEQ ID NO: 8828 - DNA, 300 bp, Homo sapiens
  misc_feature (1)...(300): n = g, a, c or t
ccattcanacaattgcccccttgtgggaatgcgggaatgaatggtacagtggacaccccagcaccattgacgttataaacatgtaaatgaaacacattagggcagacaatcaattgtctgtgagcattgcaaacctgcactccctctctctgtgacaggcacaaaatagtgtctaccttgggaagccacggtgctgagaggaaaaggacaaagaatttcctttcacacagaagaaaatgcaccttaaaagccttggaagaatgcagatgacaaaaactgttgcaaggaaaagaatctccc

SEQ ID NO: 8829 - DNA, 616 bp, Homo sapiens
  misc_feature (1)...(616): n = g, a, c or t
ccagtggaatgatgncccctgcaattaccatctcacctatacgtgcaagaaaggaacagtcgcttgcggccagccccctgttgtagaaaatgccaagacctttggaaagatgaaacctcgttatgaaatcaactccctgattagataccactgcaaagatggtttcattcaacgtcaccttccaactatccggtgcttaggaaatggaagatgggctatacctaaaattacctgcatgaacccatctgcataccaaaggacttattctatgaaatactttaaaaattcctcatcagcaaaggacaattcaataaatacatccaaacatgatcatcgttggagccggaggtggcaggagtcgaggcgctgatccctaaaatggcgaacatgtgttttcatcatttcagccaaagtcctaacttcctgtgcctttcctatcacctcgagaagtaattatcagttggtttggatttttggaccaccgttcagtcattttgggttgccgtgctcccaaaacattttaaatgaaagtattggcattcaaaaagacagcagacaaaatgaaagaaaatgagagcagaaagtaagcatttccagcctatcnnattnctttagt

SEQ ID NO: 8830 - DNA, 396 bp, Homo sapiens
  misc_feature (1)...(396): n = g, a, c or t
ctgactcaaggaccancnnatctttcttggctgctgtgttttctacccagcaaagggtccggtgggaaccccctcagccaaatgggagccactgacttctgtggggcccagaatctgactcaggcccagggaaatctgattcccacgtcaaagctcaggactcggagctgcactggttccgaacacagagcaggcataaagttctgatgccagaagaaggcaggaaactccaacgagctttaatcactctcccatcacgaacagctctagtgacagcttggcctttctatcccangagttcaaagagtttccatcgttcattctcacaaaggcccatgtcccctctgcctcgttcctgcttcactttattgaagtaactgtgaccccagatagaat

SEQ ID NO: 8831 - DNA, 162 bp, Homo sapiens
  misc_feature (1)...(162): n = g, a, c or t
ccaccantgagttactgggcccacatntgcctgcaagagggggaggggaattcangtaacccacaagaggggataaaagtncggggaagaaatctcctgtcaaggagtttgtttttgcagtggatcctctgnantgagantngntgtctntacaatatcatt

SEQ ID NO: 8832 - DNA, 432 bp, Homo sapiens
  misc_feature (1)...(432): n = g, a, c or t
ctggcattggtctananctttataaggccattcagcgagggaccatcaagtgcaactttgcgggggttgccttgggtgattcctggatctcccctgttgattcggtgctctcctggggaccttacctgtacagcatgtctcttctcgaagacaaaggtctggcagaggtgtctaaggttgcagagcaagtactgaatgccgtaaataaggggctctacagagaggccacagagctgtgggggaaagcagaaatgatcattgaacagaacacagatggggtgaacttctataacatcttaactaaaagcactcccacgtntacaatggagtcgagtctagaattcacacagagccacctantttgtctttgtcagcgccacgtgagacacctacaacgagatgccttaagccagctcatgaatggccccatca

SEQ ID NO: 8833 - DNA, 318 bp, Homo sapiens
ctgtcattccggtcatcacacaaccaatgttttcagttatcttgaataagtgagtcactgtgctggaatccaataatttgtcaggtactttcttctgtgtgacaattactgcacagtctttccctctgacagctactgatgtaaggccaccctggttaatagccttaaaagcatattctacttggtagagccgaccctcgggtgaaaaaatggtaatgtggcggtcaaaaccggcgctggaaccacgggacatgttggtacaagcactactttaaacacaatccctgggccccgtagctcccgcaccaggcacacaag

SEQ ID NO: 8834 - DNA, 560 bp, Homo sapiens
  misc_feature (1)...(560): n = g, a, c or t
ccagtgccattggtggcctctgaacaggcgctgggaaggtgttagtatgtggggctcttaccaatggagggaccaggttaggctgagagagaatctggggtgcaaactgtgtaggaaatggttgtgtcattctcacagtggcaggggctgactggaactgcttctggtagacaatgctgttcattttgctggactggctgttcggacttgtagaagtagcccggaagggactagatgttggtgtggtgcttctaccagcgattggaggtgtgcctggttttatatcaatgccacttccaaaggcttttagttccatttcagacatttttcctgtggttgcaatcatgctatgctgtgttccagcaggaattaatcctctgaaaggctggcttacttgtgcaggacgactcanactctgagcctgtgcttggggagtggtatgctgtaatgggggctgaagagtctgaggcaaagcaattagaggttgccctgtagatccaaaattaggcaaggaaagctgggatgctggtaaaggtactgtaacctgctggagagcactt

SEQ ID NO: 8835 - DNA, 254 bp, Homo sapiens
  misc_feature (1)...(254): n = g, a, c or t
ggaaaatccggattgncnnccagggagagaaaagaggcacacccggagctggtatccctcacctccaccactcagcaaggcgccggacagatatccggagggcactctgcctctgccggggggtttttttanaaaaggaatngcntagaanatacagcaagagggaactccacaacancaaaagtgttccatatcggaaaagccaaggttgtcatgttttgtttaaaaaanaaaancgncaaancncaaaacct

SEQ ID NO: 8836 - DNA, 347 bp, Homo sapiens
  misc_feature (1)...(347): n = g, a, c or t
ctgctagagatgtgcanggatgtctgtgaagccatggaatacctggagtcaaagcagttccttcaccgagacctggcagctcgaaactgtttggtaaacgatcaaggagttgttaaagtatctgatttcggcctgtccaggtatgtcctggatgatgaatacacaagctcagtaggctccaaatttccagtccggtggtccccaccggaagtcctgatgtatagcaagttcagcagcaaatctgacatttgggcttttggggttttgatgtgggaaatttactccctggggaagatgccatatgagagatttactaacagtgagactgctgaacacattgcccaagg

SEQ ID NO: 8837 - DNA, 449 bp, Homo sapiens
  misc_feature (1)...(449): n = g, a, c or t
cctggctcaacaaaanggctggggattggccctgaaaggagagagctgactgtcctggctgatggacaggagatcctcttagcactaccctaaggcaggcagttgggcattggtgtagacaacaggaaagtccaggctatagccgtactcaaaaacctttctgttccctttctgccagccctagggattgagtccacattcagcacaggactctctgggtacagctctctttaggaagacacaaattgcatggtgaagtcagttatatcctggccgcctttggtccctcccaggaagacgggcatgttttctgcttgagaggtgctgatgtaccagttggggaactgggcagactcaaattccagcttgttattgatttctatcttgttgaagacaaatcgcttttccatcttcttctttgggtaatttttgggatctacactctccag

SEQ ID NO: 8838 - DNA, 616 bp, Homo sapiens
  misc_feature (1)...(616): n = g, a, c or t
ctgtgagcccagctangacctcagaggggctgcgtctctgcactgcacgccccagggagactggagccctgaagcccctagatgtacagtgaaatcctgtgatgacttcctgggccaactccctcatggccgtgtgctacttccacttaatctccagcttggggcaaaggtgtcctttgtttgcgatgaagggttccgattaaaaggcaggtctgctagtcattgtgtcttggctggaatgaaagccctttggaatagcagtgttccagtgtgtgaacaaatcttttgtccaaatcctccagctatccttaatgggagacacacaggaactccctttggagatattccctatggaaaagaaatatcttacgcatgcgacacccacccagacagagggatgaccttcaacctcattggggagagctccatccgctgcacaagtgaccctcaagggaatggggtttggagcagccctgcccctcgctgtgaactttctgttcctgctgcctgcccacatccacccaagatccaaaacgggcattacattggaggacacgtatctctatatcttcctgggatgacaatcagctacatttgtgaccccggctacctgtta

SEQ ID NO: 8839 - DNA, 510 bp, Homo sapiens
tctaaaggtaaaccaatctttgacaatgccaatagcagtgtcaatgttcctaaatgttggctgtatctatctacttactcattgtattcttgaggtttctttcctttggtttctatgatattccacatccctctcttttcattccattgtgtgagttctctctgtggatcttttgttagctcctcttattccttcttgcctatctgagtttcctgaaattaccttcaaatcatgtctcgaaagatgttctaaagagacctttgaataagaacaacatttgtcccattaataaatggtgggagtttcatatatctgtttctttttctcttctttcctctttgccttgtccaaaagagtgggaactgagcagtacagtcataaattaattttaatatcttaacttaggcatcagtacactggctattgttccttaatacatttaacacatagtcattgactgctgattatgtgccaagggctgtgcttggcactggggataaagaagttatt

SEQ ID NO: 8840 - DNA, 574 bp, Homo sapiens
  misc_feature (1)...(574): n = g, a, c or t
ctggggtgggcttctcctactccgatgacaagttttatgcaactaatggcactgaggtcgcccagagcaattttgaggcccttcaagatttcttccgcctctttccggagtacaagaacaacaaacttttcctgaccggggagagctatgctggcatctacatccccaccctggccgtgctggtcatgcaggatcccagcatgaaccttcaggggctggctgtgggcaatggactctcctcctatgagcagaatgacaactccctggtctactttgcctactaccatggccttctggggaacaggctttggtcttctctccagacccactgctgctctcaaaacaagtgtaacttctatgacaacaaagacctggaatgcgtgaccaatcttcaggaagtggcccgcatcgtgggcaactctggcctcaacatctacaatctctatgccccgtgtgctggaggggtgcccagccattttaggtatgagaaggacactgttgtggtccaggatttgggcaacatcttcactcgcctgccactcaagcggatgtggcatcaggcactgntgcgctc

SEQ ID NO: 8841 - DNA, 222 bp, Homo sapiens
  misc_feature (1)...(222): n = g, a, c or t
ttggcttntaattcgcncntgtacttccttttttgacaataaaagagtcaagatagcaccgaggccaggagaaagggaacgtgtaagtttttatatatacagtttccaagccaacttcgggaagccttaacctttttacggggtgggggtggggaggtaaaaagttgtgatctctgagaaaataaccgccactactctggaagtgttcatcagcagttatac

SEQ ID NO: 8842 - DNA, 541 bp, Homo sapiens
  misc_feature (1)...(541): n = g, a, c or t
tataaactgtggacaannncctctgccgatggttttcaaggacctacttttgtcctgaccacttacaagcaaactctccacacatatgaaaactttgatttggaatatgaagagctatcagaatacaaattgtggttttcaatgtcatgcctgtggttattttaatagcatacccaaaagggtgttcttttatcttaagtatttacaataccttcagagtttcagttctttattttataaagcaatgaattttaataagaatattgaaatttcttccatttgaccttctgagagaaatggaaagaactccagcttgggtagcacagcaagactccatctctacaaatttttttttaaaaattagccaggcgtgcagcacacaccagtggtcccagctaccagggaggatgaggtaggaggattgaggatcgcctgagcccaggagttcgaggttacagtgagctcgaggttacagtaactgcagtggtgccactgcactccagcctgagctggagagctggagagcaatactccatcccta

SEQ ID NO: 8843 - DNA, 452 bp, Homo sapiens
  misc_feature (1)...(452): n = g, a, c or t
ccttttacntgctgatancnnaagcaatctgtgtgcatgtgtacatatgcatctgttttcagggaaagaaaagctgttaaagccaattaaggttatgaattcttgctactactttaatattaaacctttaagtgaaaatttattgaacactattacaaatgtggcaaactgacatagctggtttactgcacaaactttaatgtcaaagggattagatcagagctccagtctcacttactgggcctataacattgtgcagggcacttatctcacctcaggaaaatggaagtaactgcttcattttacagaggtnttaaatgaaagaaatgagaaaactataaaccaacattgaagcctgaattattgcttagtatttaaagtctagtacaatttgcaatgtttttaataaaaaaactcattgataggtgtatttttacagtgtatctaaaagc

SEQ ID NO: 8844 - DNA, 587 bp, Homo sapiens
  misc_feature (1)...(587): n = g, a, c or t
gggctgtctggcaggcnnnaaactacattcagttgagtctgcaagactgggaggaactggggtgataagaaatctattcactgtcaaggtttattgaagtcaaaatgtccaaaaaaatcagtggcggttctgtggtagagatgcaaggagatgaaatgacacgaatcatttgggaattgattaaagagaaactcatttttccctacgtggaattggatctacatagctatgatttaggcatagagaatcgtgatgccaccaacgaccaagtcaccaaggatgctgcagaagctataaagaagcataatgttggcgtcaaatgtgccactatcactcctgatgagaagagggttgaggagttcaagttgaaacaaatgtggaaatcaccaaatggcaccatacgaaatattctgggtggcacggtcttcanagaagccattatctgcaaaaatatcccccggcttgtgagtggatgggtaaaacctatcatcataggtcgtcatgcttatggggatcaatacagagcaactgattttgttgttcctgggcctggaaaagtagagataacctacanaccaagtgacgga

SEQ ID NO: 8845 - DNA, 573 bp, Homo sapiens
  misc_feature (1)...(573): n = g, a, c or t
gctgtccctgatgccgtnnaaagcagatactctagaacggaaggctcccttgatggaacttagacagcaaggccagatgcacatccctggaaggacatccatgttccgagaagaacagatgatccctgtatttcaagacctctgtgcacttatttatgaacctgccctgctcccacagaacacagcaattcctcaggctaagctgccggttcttaaatccatcctgctaagttaatgttgggtagaaagagatacagaggggctgttgaatttcccacataccctccttccaccaagttggaacatccttggaaattggaagagcacaagaggagatccagggcaaggccattgggatattctgaaacttgaatattttgttttgtgcagagataaagaccttttccatgcaccctcatacacagaaaccaattttcttttttatactcaatcatttctagcgcatggcctggttagaggctggttttttctcttttcctttggtccttcaaaggcttgtagttttgggtagtccttgttctttggaaatacacagtgctgaccagacagcct

SEQ ID NO: 8846 - DNA, 547 bp, Homo sapiens
  misc_feature (1)...(547): n = g, a, c or t
ctgagatgccccttcncttctgatgggttaaataagctgggaaattacccgagaagaccccggtaccacagtgtaaagcccaacgaaggggttgtttaatggtccaggggatacagaggctttaagaaacgtttccttaacgctaattcttatctggttaaacaaaacatagcaaaacatccccgatccgctcggcagaccatacacacccagcgacggcacttgatagttaatggggtttgttttaagcagatagaaaattttaagggagtcgaatcttgtgttgaatgcgttcgtgttgaatttgggccagtgtttccttgaagatcaaatgcaggttgcattttcctattgtttgtttaacagattgataggacaaactgaattagacttttcttcctgatgattcttggctcttctgcgctattattttaaaattccacgcctagattcatctatgctaataaagatgttgactttaagctttcaatttatagatgtagttgattaatatggggtatctgttttaaagagctttgttaagtgg

SEQ ID NO: 8847 - DNA, 607 bp, Homo sapiens
  misc_feature (1)...(607): n = g, a, c or t
ggagaacctgatcatnnattctgaactcaaagacgacttgcttttgtatcaggacgaggaggcgctgaacgactccattatttctggaacactgccacggaaatgcaagaaggagctcctggccgtgaagctaaggaaccggccaagcaaacaggaactagaagaccggaacattttccccagaaggattgatgaagaaagacaggagatccggcagcagatcgagatgaagctttccaaacggctgagccaaagacctgccgtggaagagctggagagaagaaatatcttgaaacaaaggaatgatcagacagagcaggaagaaagaagagaaatcaagcaaagattgacaagaaagcttaatcagagacccactgttgatgaattaagagacagaaaaattctgatacgattcagtgattacgtggaagtagcaaaagcgcaggactatgacaggagggcagacaaaccctggacgagactgtcagcagcagataaggcagcaattcgtaaagaattaaatgagtacaaaagtaatgaaatggaggtacatgcatcaagcaagcacttgacaagattccacagaccatagagattttcttctgag

SEQ ID NO: 8848 - DNA, 572 bp, Homo sapiens
  misc_feature (1)...(572): n = g, a, c or t
gaaggcaccnncttacagatggtctgtatcatcttcctgtgagtgctctcagtctgaatgatcatcttcaatattctatctagtgatggagtgagaaaattctcctgaactctgggcaggaagttcatattgctcagggtgagccaccatgataaaaataactcacacaggctaattacaattaatctaggctcttgacctttaaaaaatgtatataatgtttacatatgtttataatgtcacgccatttatttcatttaaaattttaaatgattttatctttggtcctctcttacaacttattcttggtacaacttattctttgtactataacagcagagatgagtaattgggacagactagcctccaaagcataaacttatttatgatttggccctttacagtaaaagtctgctcatcccaggntttgcttgtcaatttatatactggcgtttgttcctgatcctatttatttatttctggcatccaactctggtagtttctttctgaatcagtttaatgaagtttgtaaatgatngtaattaaacgttatttattacttttnatttttt

SEQ ID NO: 8849 - DNA, 582 bp, Homo sapiens
  misc_feature (1)...(582): n = g, a, c or t
ccactgtgaaaaancnnccccctcaaaacttcaggagaatgtatataataaatgaaggtacaatttcataccttcacaggattattgagaaggtcaaattacataacagatatgaaagcactgtgtaaactatgcggactatgctgcaccaaataactgtaaagaattattaactagactgtaaatgccttgagggcaaggaatgcatctgcaacgggtatttgtgaagtacttgacagtttgctaaggacttctgtggattttcctcatatgctactcataacaaccctggaaggtaaggggaattgttatcccaaattccaaataaagacactgcaggtcagacatcacacaggtggtaaatagcaattctggtacttactttagatattctgctacaggcttgctattcaaagtgtggtatgtagaccagcaacattgactctctgngctatctttcttttttataaactcggaattatttcaaaataagaagtttctaacaaaagagattcanaagagtcaaacccttgggtgtgaaaaagttttaggaagactttcctgaatttatttttgcctata

SEQ ID NO: 8850 - DNA, 466 bp, Homo sapiens
  misc_feature (1)...(466): n = g, a, c or t
ctgtctaatccctncnngaactgtttatagaagcttgagaatggggtaaaaatttctgctagcaaaatcaagttctttttgaaattttatnagtaatccagaatttagtagtccatgccttctcactcagcatttagaaataaaaatgtggtttcttaaacgtatatcctttcatgtatatttccacatttttgtgcttggatataagatgtatttcttgtagtgaagttgttttgtaatctactttgtatacattctaattatattatttttctatgtattttaaatgtatatggctgtttaatctttgaagcattttgggcttaagattgccagcagcacacatcanatgcagtcattgttgctatcagtgtggaatttgatagagtctagactcgggccacttggagttgtgtactccaaagctaaggacagtgatgaggaagatggcagtggacctcggccg

SEQ ID NO: 8851 - DNA, 340 bp, Homo sapiens
  misc_feature (1)...(340): n = g, a, c or t
ggaatgacnnnagacgtggctggaaagctggggccagatggcggagactcctcagctccacgttaacaacgtgctcccttggcaagccgtacagatcctttgaaggattttgagcagagaaatgacaagtttatactagaaacaagcagcatggaaggtaggctgcctgcatggagtctggaggaggagagcagcgcagagaatagtgtaaattcttcctgcaagtagtattgaggaggtacaaatgggaggatagaactggatttaaanagttttcagagagaagaaagtcaagtgaaataggacaaagagtccaaagtcagtccgtggtctccattcg

SEQ ID NO: 8852 - DNA, 492 bp, Homo sapiens
  misc_feature (1)...(492): n = g, a, c or t
taccaagacctgctcaatgttaagatggcccttgacattgagattgccacctacaggaagctgctggaaggcgaggagagcaggatttctctgcctcttccaaacttttcctccctgaacctgagggaaactaatctggattcactccctctggttgatacccactcaaaaaggacacttctgattaagacggttgaaactagagatggacaggttatcaacgaaacttctcagcatcacgatgaccttgaataaaaattgcacacactcagtgcagcaatatattaccagcaagaataaaaaagaaatccatatcttaaagaaacagctttcaagtgcctttctgcagtttttcaggagcgcaagatagatttggaataggaataagctctagttcttaacaaccgacactcctacaagatttagaaaaaagtttacaacataatctagtttacagaaaaatcttgngctagaatactttttaaaaggtat

SEQ ID NO: 8853 - DNA, 304 bp, Homo sapiens
  misc_feature (1)...(304): n = g, a, c or t
ttgtatatctcgttagtaatgtacatgctcttcaggttctagggctcctgttaggggagggagaaatgttgaatcaagagggaaaacaactactatgatttataaacatattttaatgtaaaaatttgcatttaaaaggagtggccctgttttctgtgttaaaaccccatttggtgctattgagtttgttctttattcttttatcccagtgaaaattgttgatcttgctgtanggaaaaattaaactctttgaatctccaaacaaggaagtttcagcattcccttatggatcagaggaacctta

SEQ ID NO: 8854 - DNA, 379 bp, Homo sapiens
  misc_feature (1)...(379): n = g, a, c or t
ggtcatgatgcagaagctactcaaatgcagtcggcttgtcctggctcttgccctcatcctggttctggaatcctcagttcaaggttatcctacgcagagagccaggtaccaatgggtgcgctgcaatccagacagtaattctgcaaactgccttgaagaaaaaggaccaatgttncgaactacttccaggtgaatncaacaagatcccccgtctgaggactgacctttttccaaagacgagaatccaggacttgaatcgtatnttcccactttctgaggactactctggatcaggcttcngctccggctccngctctggatcnggatctgggagtggcttcctaacggaaatggaacaggattaccaactagtnggacg

SEQ ID NO: 8855 - DNA, 491 bp, Homo sapiens
  misc_feature (1)...(491): n = g, a, c or t
ctggttctnnaatcctcnnntcaaggttatcctacgcagagagccaggtaccaatgggtgcgctgcaatccagacagtaattctgcaaactgccttgaagaaaaaggaccaatgttcgaactacttccaggtgaatccaacaagatcccccgtctgaggactgacctttttccaaagacgagaatccaggacttgaatcgtatcttcccactttctgaggactactctggatcaggcttcggctccggctccggctctggatcaggatctgggagtggcttcctaacggaaatggaacaggattaccaactagtagacgaaagtgatgctttccatgacaaccttaggtctcttgacaggaatctgccctcagacagccaggacttgggtcaacatggattagaagaggattttatgttataaaagaggattttccnaccttgacaccaggcaatgtanntangcatattttatgtaccatggttatatga

SEQ ID NO: 8856 - DNA, 469 bp, Homo sapiens
  misc_feature (1)...(469): n = g, a, c or t
ttagttttagctcttgtattcatgtctgtaatcaattgaagttaatttttaatatagtatgtgttgggagtccagcttcattgttttgcatgtatctatgcaattgacccaaagtgatttgttgaaaaatattattttctgatggtatggtcctgacacccttgtagaaattcaattgaagatatatgtatgagtttacttctgcagtctcaattctattctattggtctaaatgtttatctttatgccagtaccagcctgttttggttattttagttttgtaataaaatagacaaacatttggccgattaatcaagacaaaaagaaaagtatatagaaataatattatgaaagaaaagggggagcatattgaaaaacaccataaagattaaaaagattaagggacagtgttaacaatttatgccaataggttttgataattnatattttgctaggaatttgnctattt

SEQ ID NO: 8857 - DNA, 262 bp, Homo sapiens
aaaaatagaagatgaatcattgattgaatagttataaagatgttatagtaaatttattttattttagatattaaatgatgttttattagataaatttcaatcagggtttttagattaaacaaacaaacaattgggtacccagttaaattttcatttcagataaacaacaaataattttttagtataagtacattattgtttatctgaaattttaattgaactaacaatcctagtttgatactcccagtcttgtcattgccag

SEQ ID NO: 8858 - DNA, 418 bp, Homo sapiens
  misc_feature (1)...(418): n = g, a, c or t
ctgttaaatacctcccngcatttttttttcctgatttaatattgctatgaacaggaaagtgtgtaaaagtaaaaagtgtatactatttacagatttaaagctttctttgaccttgtcaagggttaagcgactcatttgcatttagtataatgatatgcaaatcttttactttgatgtgtgaaacttctgctatctcaaattgacagtatcattattttcagctatgatcatccgtttaagtaaatgttcccataattttgaggtccagatacaaagtgtatttctatggaagcttagtccttggctgattttccatcatgagaagtcttcaggcagattagttataacttcaaagtactgagaaacagagccaagagataaggtcgagctctattgttccagtattctcgggatccag

SEQ ID NO: 8859 - DNA, 509 bp, Homo sapiens
  misc_feature (1)...(509): n = g, a, c or t
gtggagaagagaaaannncagggcaggctggatggcatggctcacacctgtaatcccagcactttgggaggccatggagggaggattgaggccaggagtttgagaccagcctgggtgacattaaaagaccctgtctcaaagaaaacgaaaggagcagggtatatacaaggggtctgccagccttctcagcctttctgtgagaagcgagggtagggtagtacaggagagtggcaggaggtgacactaaaagtaggtctgtgttgatctaacgagtctcaactttactgccaaaactaatgaactaggaaagtttaggcagcaagggccagagatggagtctggacttgtattgcagaaagttcctgtgacggcagcttggagggtgaatgagagtgtgggatggaggggtgaatgggtgtggacagactggaaaaatgactcatgcagggaatgaggaaggnaggagccttgggagactctcaaatccctggcttagcctactgaattgc

SEQ ID NO: 8860 - DNA, 281 bp, Homo sapiens
  misc_feature (1)...(281): n = g, a, c or t
ctgctcggaggacnnntacagtgagctgctgcaggagatcacagacaacctgacgaagaaggagattcagatagagaagatccatttggacacgtcctccttcatggaggagctgcctggagagaaggaccttgcccacgtggtagagatctatgactttgaaccagcgctcaagacggaggacctgctggcaacgttttctgagttccaagagaaggggttcaggattcagtgggtggatgatactcgcgcactcggcatctttccctgccgggcctcag

SEQ ID NO: 8861 - DNA, 514 bp, Homo sapiens
  misc_feature (1)...(514): n = g, a, c or t
tccacatacaatatctgtgtaaaacgatttcctgtagaagtagctttaatggtttttgctctagaataccgtaggtctatccttagagcactcacgccatgctttcttccctgggttttaaacttcatataactttcagaaattggagagcaaaaattttgcttgtcactgcacatcaatataaaaaagcttatttaacttatcaaaacgtatttattgccaaactatgcttttttttgttaattttgttcatatttatcgggatgacaaatccatanaatatattcttttatgttaaattatgatcttcatattaatcttaaaattttgtgacgtgtctttttcctttttttccacagttttaatatattattcttcaacgacattttttgtaactttacacttttttggttattttattttaaaaaaatgaaaaattaatttaaanaaatnncaaaaaactgntggattatttattttagaaattcccccctttgtgttggactgcaaattg

SEQ ID NO: 8862 - DNA, 588 bp, Homo sapiens
gagcattttaaatagtacagtaggctggtatacattaggaaatggactgcactggaggcaaatagaaaactaaagaaattagataggctggaaatgcttactttctgctctcattttctttcattttgtctgctgtctttttgaatgccaatactttcatttaaaatgttttgggagcacggcaacccaaaatgactgaacggtggtccaaaaatccaaaccaactgataattacttctcgaggtgataggaaaggcacaggaagttaggactttggctgaaatgatgaaaacacatgttcgccattttagggatcagcgcctcgactcctgccacctccggctccaacgatgatcatgtttggatgtatttattgaattgtcctttgctgatgaggaatttttaaagtatttcatagaataagtcctttggtatgcagatgggttcatgcaggtaattttaggtatagcccatcttccatttcctaagcaccggatagttggaaggtgacgttgaatgaaaccatctttgcagtggtatctaatcagggagtttgatttcataacgaggtttcatctttccaaaggt

SEQ ID NO: 8863 - DNA, 132 bp, Homo sapiens
  misc_feature (1)...(132): n = g, a, c or t
aaacttgnttattatgtacaaatngattcttatantattatttaaatgantgcatttttaaatacaaggctttatatttttaactttaanatgtttttatgtgctntccaaatttnttttactgtttctnga

SEQ ID NO: 8864 - DNA, 581 bp, Homo sapiens
  misc_feature (1)...(581): n = g, a, c or t
ctgtgaaanagccaaaannncccaaactaggctgatactcctgtgttgacctgaggtcattntgtgcctgtcaaaccaaataacacattcaatcttttgtatatttngaagactcanaaacccanaaatttttanaacctntntctcactctaattaaaacctactgctctgtcaatgggaaagaatgagtccaaacattctgaaaaccgtacaaatgtgtttacattttagtgggggcttcctgcatctttaacctctttaaattgacataggtaagatcttgtgtaataacacatttgcaaatatgcagatgcattttcaaatgaatataatcctgatttagagaatattaactgactatcatagtagactatggataatactctaataattaattacaggttaacatttttaaaactcaaagcatatgctttaagtttatgctttaagccacgttatgttctacttcagcctaatacaagggagaaatttggagggggccctcctagctttctagtctcattattcccaaattagaaacattaccagcctaacactaactctggggtctaaaatgaag

SEQ ID NO: 8865 - DNA, 498 bp, Homo sapiens
  misc_feature (1)...(498): n = g, a, c or t
ctgtgaggagattcccnntcagacaactttgctgaaagcagcttggaaattcggtgtcgaagggtctgccacgttttcatgcttgcattttgggctccaaattggcactgggaaggggttactgagagcacaaggctgataccaggccctacttttaaacgttcatctacttacaatcctagtatttctctaaaaaccaaaacctctttgaattaacagtttcatgctgtgaatttctagtgggagatcttttccttgatattgacgacacaattttccatgtacttttaaagcagggagtggggaaaagtattttgaggggacattttcatcatcagttcagctttttttttttggttgttgctcttttttgggggggttgggtttgttggtttcactgaaacatttaactacctgtaaaatctaaacatggctgttagtgtcacaccaattcnggacacanaatggctaacactggaagtatgtnnnagagttcca

SEQ ID NO: 8866 - DNA, 231 bp, Homo sapiens
  misc_feature (1)...(231): n = g, a, c or t
gaaaaacangatggagnnccagggcaaccccaaataccgcgccctctctgagcaaggcgtctgcaccctagagatccggaaacccagcccctttgattctggggtctacatctgcaaggccataaatgtgctgggggaggcatctgtggactgccggctggaggtcaaagcctcagccgcacactgaagagtcacgggaggaggctgtgatgaggagccaggtgctgcagg

SEQ ID NO: 8867 - DNA, 606 bp, Homo sapiens
  misc_feature (1)...(606): n = g, a, c or t
cctaagaactgagacttncgacacaaggccaacgacctaagattagcccagggttgtagctggaagacctacaacccaaggatggaaggcccctgtcacaaagcctacctagatggatagaggacccaagcgaaaaaggtatctcaagactaaaggccggaatctggaggcccatgacccagaacccaggaaggatagaagcttgaagacctggggaaatcccaagatgagaaccctaaaccctacctcttttctattgtttacacttcttactcttagatatttccagttctcctgtttatctttaagcctgattcttttgagatgtactttttgatgttgccggttacctttagattgacagtattatgcctgggccagtcttgagccagctttaaatcacagcttttacctatttgttaggctatagtgttttgtaaacttctgtttctattcacatcttctccacttgagagagacaccaaaatccagtcagtatctaatctggcttttgttaacttccctcaggagcagacattcatataggtgatactgnatttcagtcctttcttttgaccccagaagccctagactgagaagataaaa

SEQ ID NO: 8868 - DNA, 550 bp, Homo sapiens
  misc_feature (1)...(550): n = g, a, c or t
ccacactctacttctgcntctgccacctatggggtcgaggcaggtgtggtgccttggctaagtccacagacttctgagaggcccacgctttcttcttctccagaaataaaccctgaaactcaagcagctttaatcagagggcaggattccacgatagcagcatcagaacagcaagtggcagcgagaattcttgattccaatgatcaggcaacagtaaaccctgtggaatttaatactgaggttgcaacaccaccattttcccttctggagacttctaatgaaacagatttcctgattggcattaatgaagagtcagtggaaggcacggcaatctatttaccaggacctgatcgctgcaaaatgaacccgtgccttaacggaggcacctgttatcctactgaaacttcctacgtatgcacctgtgtgccaggatacagcggagaccagtgtgaacttgattttgatgaatgtcactctaatccctgtcgtaatggagccacttgtgttgatggttttaacacattcaggtgcctctgccttccaagttatg

SEQ ID NO: 8869 - DNA, 580 bp, Homo sapiens
  misc_feature (1)...(580): n = g, a, c or t
ctgccgttctcacacngctctacttagactcaatagcagcaccattaagtatctagactttgtctttgctgtgaaaaatgaaaaccgattttatctgaaggaagtgaacatcagcatgtatttggttaatggctccgttttcagcattgcaaataacaatctcagctactgggatgcccccctgggaagttcttatatgtgcaacaaagagcagactgtttcagtgtctggagcatttcagataaatacctttgatctaagggttcagcctttcaatgtgacacaaggaaagtattctacagcccaagagtgttcgctggatgatgacaccattctaatcccaattatagttggtgctggtctttcaggcttgattatcgttatagtgattgcttacgtaattggcagaagaaaaagttatgctggatatcagactctgtaacactaatcaatacgtgatctctgttacaaaagaaaaaagcaagtacaagttccaacatgcaatactggtcaacttaaggtatatttagttgcagtccanctctttanaatgggtggnatgggggatttcaaacttaaa

SEQ ID NO: 8870 - DNA, 312 bp, Homo sapiens
  misc_feature (1)...(312): n = g, a, c or t
ctgttctcaacaanccnattttatttttttaatcaggcattgccagaaaattttgtacattaacctggaccagtgatggttctgtaccctctttgctgtgaaacacgacatgagctaaaggcaaagaccggttctcacaaggacaactgcttcaagttaggaaccagaacagtgcatttaaacagtcttcttagatattttcttgcctttcttaaaaaccagcttatttttaatgtagccacgcttccttttggtagtcttctttgacaaatacttctgttttgggaaaatgttggtgactcgaggtttgtg

SEQ ID NO: 8871 - DNA, 244 bp, Homo sapiens
  misc_feature (1)...(244): n = g, a, c or t
cctgtctaacctcncctgtggagtctgcgtgggcatcgtgggcagtggggctgccctggccgatgctcanaaccccagcctctttgtaaagattctcatcgtggagatctttggcagcgccattggcctctttggggtcatcgtcgcaattcttcagacctccagagtgaagatgggtgactagatgatatgtgtgggtggggccgtgcctcacttttatttattgctggttttcctgggacag

SEQ ID NO: 8872 - DNA, 437 bp, Homo sapiens
  misc_feature (1)...(437): n = g, a, c or t
cctcacgcanaaactagnncngttcatgaaaacccgagatactctgccagcttcttgaggaagcantgttgncacacttttctgagcttcantgattcacacattttgataagacagcatgttctgtgggttaagtacatttaccttttnaaaatatactcccatgaagtatcatggttcagaattacacacttacaaagttaaatggcataaaactactttgtaaaaagtgcctacactctaaaaggtgatttaaaggtttatgacatcttaattcaagtgaatactgaatcagtaggattatagagcaggtgctctaagttagggaatctggagtcagtctctcctttgcttatgtgcaatgtggacccagggatttctcaatttctctgtcagaatttttaacatggtaaaatggctattattatatggaatga

SEQ ID NO: 8873 - DNA, 363 bp, Homo sapiens
  misc_feature (1)...(363): n = g, a, c or t
gccgccgcggactccggcnnctttatcgccagagtccctgaactctcgctttctttttaatcccctgcatcggatcaccggcgtgccccaccatgtcagacgcagccgtagacaccagctccgaaatcaccaccaaggacttaaaggagaagaaggaagttgtggaagaggcagaaaatggaagagacgcccctgctaacgggaatgctaatgaggaaaatggggagcaggaggctgacaatgaggtagacgaagaagaggaagaaggtggggaggaagaggaggaggaagaagaaggtgatggtgaggaagaggatggagatgaagatgaggaagctgagtcagctacgggcaagcgggcag

SEQ ID NO: 8874 - DNA, 537 bp, Homo sapiens
  misc_feature (1)...(537): n = g, a, c or t
catcaagagatacttcaccctcaagtggttcagcagtttcttcatcaaaggtgttagacaaacccagtaggctaactgaaaaggaacttgctgaggctgcaagcaagtgggctgctgaaaagctagagaaatcagatgaaagtaacttgcctgaaatttctgagtatgaggcgggatccacagcaccattgtttactgaccagccagaggaacctgagtcaaacacaacacatgggatagaattatttgaagatagtcagctaaccactcgctctaaagcaatagcatcaaaaaccaaagagattgaacaggtttaccgacaagactgtgaaactttcgggatggtggtgaaaatgctgattgaaaaagatccttcattagaaaagtctatacagtttgcattgaggcagaatntacatgaaataggtgagcggngtgttgaagaactcaagcatttcattgcagagtatgatacttccactcaagattttggagagcctttttagattttttctgcttcaggctaaaaaaaaaaaa

SEQ ID NO: 8875 - DNA, 585 bp, Homo sapiens
  misc_feature (1)...(585): n = g, a, c or t
ccacactctacttctgcnnctgccacctatggggtcgaggcaggtgtggtgccttggctaagtccacagacttctgagaggcccacgctttcttcttctccagaaataaaccctgaaactcaagcagctttaatcagagggcaggattccacgatagcagcatcagaacagcaagtggcagcgagaattcttgattccaatgatcaggcaacagtaaaccctgtggaatttaatactgaggttgcaacaccaccattttcccttctggagacttctaatgaaacagatttcctgattggcattaatgaagagtcagtggaaggcacggcaatctatttaccaggacctgatcgctgcaaaatgaacccgtgccttaacggaggcacctgttatcctactgaaacttcctacgtatgcacctgtgtgccaggatacagcggagaccagtgtgaacttgattttgatgaatgtcactctaatccctgtcgtaatggagccacttgtgttgatggttttaacacattcaggtgcctctgccttccaagttatgttggtgcactttgtgagcaaggataccgagacatg

SEQ ID NO: 8876 - DNA, 241 bp, Homo sapiens
ctggcccgacctctggccccctcttccctggctgaatgtaaatatttaccagcatttagaaaaaaggagaaaaaagacagaactaaacccgtttaggaaaaagggaccgagggacagcagtggttaagtaatccactgaggacctgaaggggaaaatggacttacctttctcatatacttggcctggctagggcactgggtgccagacagccttctgaggggattttctttctaaatgagg

SEQ ID NO: 8877 - DNA, 579 bp, Homo sapiens
  misc_feature (1)...(579): n = g, a, c or t
tgaacatgtagtcacagnntcaccaatcaaaaaggaagaaagtacaaaacattttccgaaaggcatgagaccaacaattcaagagtcagatactgagctcttattctctggactgggatcaggagaagaagttttacctactctaccaacagagtcagtgaattttanntgaagtggancanatcaataacacattatatccccacacttctcaagtggaaagtacctcaagtgacaaaattgaagactttaacagaatggaaaatgtggcaaaagaagttggaccactcgtatctcaaacagacatctttgaaggtagtgggtcagtaaccagcacaacattaatagaaattttaattgacactggagcagaaggacccacggtggcacctctccctttctccacggacatcggacatcctcaaaatcagactgtcaggtgggcagaagaaatccagactagtagaccacaaaccataactgaacaagactctaacaagaattcttcaacagcagaaattaacgaaacaacaacctcatctactgattttctggctagagcttatggttttgaaatgg

SEQ ID NO: 8878 - DNA, 264 bp, Homo sapiens
  misc_feature (1)...(264): n = g, a, c or t
ggctgctctgggattcncntcagccaatcttcattgctcaagtgtctgaagcagccatggcagaagtacctgagctcgccagtgaaatgatggcttattacagtggcaatgaggatgacttgttctttgaagctgatggccctaaacagatgaagtgctccttccaggacctggacctctgccctctggatggcggcatccagctacgaatctccgaccaccactacagcaagggcttcaggcaggccgcgtcagttgttgtgg

SEQ ID NO: 8879 - DNA, 428 bp, Homo sapiens
  misc_feature (1)...(428): n = g, a, c or t
ctgagcatccagatnncnagtccctgacactgtttaaccacacagtgagagctgccaaatgagaccagcagaaaaactgtccagctagccccaggtaatccatacagtcgtgacagatagacagatgtgtagttttaggccattaggttttgggataattggttaagcaacaataaataaccaaaacaaaacttaaagttatgacagtccaaataaaatttcctgaaagtcgaaagataagaaaatattccagaactgaaaatttaaaaaacatttagaaataacgtgagatataagactcaagacaagaggtctaaaatccaattaacagacacttccaaatgaacaaataaaatggaaaagagaaagttaacaacaaaaatatgacaagattcaagactccaactttgaaagagcctatccatagg

SEQ ID NO: 8880 - DNA, 328 bp, Homo sapiens
  misc_feature (1)...(328): n = g, a, c or t
agatttgantatttancctgcncaaaggccaatcttcanttatcaatgacaagaaaactctagggctgccaaaataacttnattttanaccccanagttagtgttaggctggtaatgtttctaatttgggaataatgagactagaaagctaggagggccccctccaaatttctcccttgtattaggctgaagtngaacataacgtggcttaaagcataaacttaaagcatatgctttgagttttaaaaatgttaacctgtnattaattattagagtattatccatagtctactatgatagtcagttaatattctctaaatnagattat

SEQ ID NO: 8881 - DNA, 579 bp, Homo sapiens
  misc_feature (1)...(579): n = g, a, c or t
tagagataggaacggtgggtggtgggaccaacctactacctcagcangcctgtttgcagatgctaggtgttcaaggagcatgcnaagataatcctggggaaaatgcccggcngcttgcccgaattgtgtgtgggaccgtaatggctggggaattgtcacttatggcagcattggcagcaggacatcttgtcaaaagtcacatgattcacaacaggtcgaagatcaatttacaagacctccaaggagcttgcaccaagaagacagcctgaatagcccgacagttctgaactggaacatgggcattgggttctaaaggactaacataaaatctgtgaattaaaaaagctcaatgcattgtcttgtggaggatgaatagatgtgatcactgagacagccacttggtttttggctctttcagagaggtctcaggttctttccatgcagactcctcagatctgaacacagtttantgctttacatgctgtgctctttgaagagatttcaacaagaatattgtatgttaaagcatcagagatggtaatctacagctcacctctgaaggcaaatataagctgggaa

SEQ ID NO: 8882 - DNA, 324 bp, Homo sapiens
  misc_feature (1)...(324): n = g, a, c or t
ctgggatccgccgnccagcgggcggttcagggctcccggtactcctgcgtgttaatgagaacgttcattagcgctcttgacaggacggcgactgtgagacgcctggttacctattttagtaaatcgggaacactggatgcaaggcggttggttttcgtttttaagcaagcttaaatgttggttacgctacttttggggaaagggaaacgaaaggtgaatctcgagttctaagttgctttctaagaaacccccaggatttaagagcgaaaactctctgcgacaaaacactggatacgcgagtcttaaatacagctctccaaacag

SEQ ID NO: 8883 - DNA, 599 bp, Homo sapiens
ctgttgccaagacagagattgctttaagtggcaaatcacctttattagcagctacttttgcttactgggacaatattcttggtcctagagtaaggcacatttgggctccaaagacagaacaggtacttctcagtgatggagaaataacttttcttgccaaccacactctaaatggagaaatccttcgaaatgcagagagtggtgctatagatgtaaagttttttgtcttgtctgaaaagggagtgattattgtttcattaatctttgatggaaactggaatggggatcgcagcacatatggactatcaattatacttccacagacagaacttagtttctacctcccacttcatagagtgtgtgttgatagattaacacatataatccggaaaggaagaatatggatgcataaggaaagacaagaaaatgtccagaagattatcttagaaggcacagagagaatggaagatcagggtcagagtattattccaatgcttactggagaagtgattcctgtaatggaactgctttcatctatgaaatcacacagtgttcctgaagaaatagatatagctgatacagtactcaatgatgatgat

SEQ ID NO: 8884 - DNA, 608 bp, Homo sapiens
  misc_feature (1)...(608): n = g, a, c or t
ccttattttctgagccaaccgaggcaggagacactacaacacaaaaaaatgtgaaccacagagaccaccaagtacaaaaactgcaaactcataagcattaaaaaacattgggtggaactggttagagcacattagaataatttaccagaacttgtgcagagaaaagaatgaagactggtggggaataattgacaggttctgctcccccagcttaactatcattgtgaaggttaaaataaaagaagatatgaagctctagcataataaagaacacagcagaggctatatataaaaaagttaacataaaaatctgacaggtgaaggaatagaatatcctgggaaaagcaagaactacttactaaaacctttgtttttccacttggaatctgcatacttatattgaactaataaagtattgctatgaacaaactagtagaatgaattattttaacttctcaagaccctgatatagagctatccattttgcattctaaaccctctccaggctaattgacaaaggataataccagaaatagatcaggagttaaattatagttagaaaggggagagaagtaaggnaggacattaaaattttattctgaaattat

SEQ ID NO: 8885 - DNA, 314 bp, Homo sapiens
  misc_feature (1)...(314): n = g, a, c or t
gggaaccaaagctntcatggatgaggtggtgaaagccacttctaggggctgcatcaccatcataggtggnngagacactgccacttgctgtgccaaatggaacacggaggataaagtcagccatgtgagcactgggggtggtgccagtttggagctcctggaaggtaaagtccttcctggggtggatgctttcagcaatatttagtactttcctgccttttagttcctgtgcacagcccctaagtcaacttagcattttctgcatctccacttggcattagctaaaaccttccatgtcaagattcagctagtgg

SEQ ID NO: 8886 - DNA, 608 bp, Homo sapiens
gttggtaaagaatacaggagcagaaccgggcatggtggctcagcctgtaattccagcactttgggaggctgaagtgggcagatcacttgaggtcaggagattgagaccagcctggctaacatggtgaaaacctgtctctactaaaaatacaaaaattagctgggtgtggtggcatgcacctgtaatcccagctatttgggaggctgaggcaggagaattgctcaaaataaaaaaaaaaaaataaagaactaaaaagtgtggatactgttatgccacatgtgataataaaatattcaaggccacagatgcaagtcaccaacttacaaagagaatactgaaggtagggtacattaaaaaaatagagaaatgcaataaagaaaatgccacctctgcctaaatcaggaaagagtaaatgcataggcattaaaacagcagctctgcatactacactgcatttctctttgtcaaaaagaattcactgtgtatcattacaaaggtcagtgaataagacgaggcaataaacgtagcgccttggtattagggcaaatttagttttcttttcattttacacatgagggggaaaaaagaagtgtagaactaggaatgct

SEQ ID NO: 8887 - DNA, 592 bp, Homo sapiens
  misc_feature (1)...(592): n = g, a, c or t
actgccttgaagaaaaaggaccaatgttcgaactacttccaggtgaatccaacaagatcccccgtctgaggactgacctttttccaaagacgagaatccaggacttgaatcgtatcttcccactttctgaggactactctggatcaggcttcggctccggctccggctctggatcaggatctgggagtggcttcctaacggaaatggaacaggattaccaactagtagacgaaagtgatgctttccatgacaaccttaggtctcttgacaggaatctgccctcagacagccaggacttgggtcaacatggattagaagaggattttatgttataaaagaggattttcccaccttgacaccaggcaatgtagttagcatattttatgtaccatggttatatgattaatcttgggacaaagaattttatagaaatttttaaacatctgaaaaagaagcttaagttttatcatcctttttttctcatgaattcttaaaggattatgctttaatgctgntatctatcttattgttcttgaaaatacctgcattttttggtatcatgttcaaccaacatcattatgaaattaattag

SEQ ID NO: 8888 - DNA, 570 bp, Homo sapiens
accacatcatcctcacgtgttcggtactgagcagccactacccctgatgagaacagtatgaagaaagggggctgttggagtcccagaattgctgacagcagaggctttgctgctgtgaatcccacctgccaccagcctgcagcacaccccacagccaagtagaggcgaaagcagtggctcatcctacctgttaggagcaggtagggcttgtactcactttaatttgaatcttatcaacttactcataaagggacaggctagctagctgtgttagaagtagcaatgacaatgaccaaggactgctacacctctgattacaattctgatgtgaaaaagatggtgtttggctcttatagagcctgtgtgaaaggcccatggatcagctcttcctgtgtttgtaatttaatgctgctacaagatgtttctgtttcttagattctgaccatgactcataagcttcttgtcattcttcattgcttgtttgtggtcacagatgcacaacactcctccagtcttgtgggggcagcttttgggaagtctcagcagctcttctggctgtgttgtcagcac

SEQ ID NO: 8889 - DNA, 470 bp, Homo sapiens
  misc_feature (1)...(470): n = g, a, c or t
tatcttcccactttctgaggactactctggatcaggcttcggctccggctccggctctggatcaggatctgggagtggcttcctaacggaaatggaacaggattaccaactagtagacgaaagtgatgctttccatgacaaccttaggtctcttgacaggaatctgccctcanacagccagnacttggntcaacatggattannaagaggattttatgttataaaagaggattttnccaccttgacaccagncaatgtanttagcatattttatgtaccatggttatatgattaatcttgggacaaagaattntatagaaatttttaaacatctgaaaaagaagcttaagttttatcatcctttttttctcatgaattcttaaaggattatgctttaatgctgntatctatcttattgnttcttgaaaatacctgcattttttggtatcatgttcaaccaacatcattat

SEQ ID NO: 8890 - DNA, 295 bp, Homo sapiens
ttttaaatattttattttcctgttctttgtgaaaacatcaataaatatcgaaacctctctgctctaacacagagggaaacactgcataattaacattaaacaaggcagtatgccttacaagaaagacataaaatgtccaagggatatttagaacattttagttcttaaagcttcaacatgagaaatgttgaccacacactgtgaaatcatttcaataaataacaactgacattcatctttacagttacaaaatagacacacatacatttccctgccgtcacattgatcttactgg

SEQ ID NO: 8891 - DNA, 527 bp, Homo sapiens
ttaagaacatcactcttttaagagcctccaaaaatcaggagattcaggtaagtgtcctatcaagatttatcactgataagtctagatcatcatgaagtacattggaaaggcaacaggaagcaaagtaagcccgaagattctaagggaagcaactcctttctacataggcatttaaggcatttactgctagcaagctttccctaggaaactgaaaaagagatttaacgtccatcaaaagtaaaggaagaactttctcctggtgtggcagaagtatgtgtttttaattagtcattgattagaagtattggtatcaagatggaaatgatgatgattttcaatttcaaggaagagattatattcctcatatgtattctgccaacaggttttgttttttaaaatattttgaacagaaaatataattcataaacttaatcctctaaaaatcacaataggaagtcagctaaactaactctaatccaaccattctagtatatactatccaagggctgaagtgtcaggcaatgact

SEQ ID NO: 8892 - DNA, 604 bp, Homo sapiens
ccacgaagcaccgccaggacagttttcaaggaagagaaagtaaagggtctccaaagaagcggctggatgtccgtctgtcgagaacgtccagcgtggagcggggcaaggagagggaggaggcttggagctttgacggggcattggagaacaagcgaactgccgctaaggaatctgaggagaacaaggagaacctgatcataaattctgaactcaaagacgacttgcttttgtatcaggacgaggaggcgctgaacgactccattatttctggaacactgccacggaaatgcaagaaggagctcctggccgtgaagctaaggaaccggccaagcaaacaggaactagaagaccggaacattttccccagaaggactgatgaagaaagacaggagatccggcagcagatcgagatgaagctttccaaacggctgagccaaagacctgccgtggaagagctggagagaagaaatatcttgaaacaaaggaatgatcagacagagcaggaagaaagaagagaaatcaagcaaagattgacaagaaagcttaatcagagacccactgttgatgaattaagagacagaaaaattctgatacgattcagtga

SEQ ID NO: 8893 - DNA, 270 bp, Homo sapiens
  misc_feature (1)...(270): n = g, a, c or t
tcgacattctttttgttactgatacgtttaatngttntgtttgtaaggttccanaatatcttaaccatgtaagtaaacgcttanaggaagagggagacagagtaatcacttacttggaccacagcacacagtaagtaccgtttgctcnctgagcgttcntatcttcaccgnggctggaaggtnctcctgnctggttattgaaataaagggtgtctttgtcaattcattcagtnctaagagngnttntgcacctagcatattttactttgt

SEQ ID NO: 8894 - DNA, 597 bp, Homo sapiens
ccatccctggcactgagcccatgctgttcatctggacagagtggttcattggggaggctgcacgaggtcccatgggtgcttgtggcaactggacgttccccaaggacatggggttaaatgaattcatcccttgagaaacttgcatgcgattcactggcagggacaggggtccatttggaggtctcacaggttgtgcctgtggaatcacagggggctgagcccccggggctggtaaggctggctggttccccaagatgccttgtttatgtaaacgcgacctccgtttttcttctagttctttttgtatcttgtagattttctctgctaataagtgataatattcatccctgctgttggcagactcgtacatgtccccttccactttcttagcataggctaccaggttttccatgcggcgatcctttagagctgcgggatcaggtgttgggaagatggcttggacgagtttatgcactagatggctccgcaggtcctgagtgacatgttcgtgccagcctttccttacaccggtgctagaaggaggagctgctgttggtatagtgctgagggttccaatgttaccagagttggagccat

SEQ ID NO: 8895 - DNA, 435 bp, Homo sapiens
ccttcccactctttgtagtgccaggaaaatactgaatgtaagtgggtgcagctttgctcgctgtgaggagcagcagaatgcggcagcctctcctcccagaatctaggaatctgggaggcacaggacatccccaaaaggtcccaaacagttccagaccctatgtcttaccctccaccctaccagggaatgactatctacactaatgaagggctactgcccccatggctgaagccacagaatggtacaggagagaagactgtaatttgtgaccagaaacaggcaagctgtccctcccagccccaaagaatgggaacctgcccaccagtggcaccagggctgggggctaggagagatggcatccatcaaggagcccttaagaggctgcatctttaaggaccaggaaatgagtccatcagttaccaaggcttctcacag

SEQ ID NO: 8896 - DNA, 384 bp, Homo sapiens
  misc_feature (1)...(384): n = g, a, c or t
ctggtgcancttgcctcaatatcttatcactaagtgcattcctggacctgctttgagtcagtttacactanttatgcaattaagggtggaaggtaaagggggctgcacgtgaagaaactaaaatggagtctgtccggctctctctccgctaggagagagtcactcaggttaaaacaaggtagggtatcacaggaccatgtacaattcttcaaactccagcttcaactctctttcttattgctctcttaggacagtatatttagatcagagtaaatgaaagtaatgttattangagataagattaaaattgatcccatttgtaaaaagggaagtagattatttgtgaactgtaatactttttttactgaagaatcaccttaaaac

SEQ ID NO: 8897 - DNA, 593 bp, Homo sapiens
ctgactgactttgggcaaattccttcctctttccagatgccagtttctcaacaataaagtgagggagctttgctccgatttccctccttctcttactgcctaaacttgtcagatagaacttcaagtttgcttcaccttaggtcctgattgccaccacagtggggacagcagggacggtccccaagcctgaagcaagaagaggacagagaaggatgaactgcaggagactttgcctaagcagaaatccaaaccccatttttccctaaagatgaggcatcttacttcaaggacatttgtcaagttgttaaagttcccttgatggtctctcagaagccctggaacttctggaaatcacttgaactgtgataagaattctccttagagctgcctgagaatagcaggacacggcaggcgaggagggggagtcacctgctgccttaatcctctcagacagaaatgaaatttctcccaccgaagggtttccttgggcttcagggagctcacaaagctgcttgctagaaagaatatttagtccaagctgggaggagtggtgattttgataagaaaatcaagagccccattcacgttcccag

SEQ ID NO: 8898 - DNA, 600 bp, Homo sapiens
  misc_feature (1)...(600): n = g, a, c or t
ccatcttcccatctcccatgatgtatgctggaccaactgaggtccagtggcattgcagagcacggatggttgcaggagccaacttttacattgttggacgagaccctgctggcatgcctcatccagaaacagggaaggatctttatgagccaagtcatggtgccaaagtgctgacgatggcccctggtttaatcactttggaaatagttccctttcgagttgcagcttacaacaagaaaaagaagcgtatggactactatgactctgaacaccatgaagactttgaatttatttcaggaacacgaatgcgcaaacttgctcgagaaggccagaaaccacctgaaggtttcatggctcccaaggcttggaccgtgctgacagaatactacaaatccttggagaaagcttaggctgttaacccagtcactccacctttgacacattactagtaacaagaggggaccacatagtctctgttgacatttctttgtggtgtctgtctggacatgcttcctaaaaacagaccattttccttaacttgcatcagttttggtctgccttatgagttctgntttgaacaagtgtaacacactgatggtt

SEQ ID NO: 8899 - DNA, 595 bp, Homo sapiens
  misc_feature (1)...(595): n = g, a, c or t
cctcctcnaccaaggcagggaacttcaatctgtataagtatctgcagttgctggaataatttgaagaccccatggagctaaggagattaagtggaggattttcattgtttcagaggggcaaggggcaaatccattgctaattctttaatgatgaaaaatggtaagaagttgttaaactcctttggggattttaaaaagtgatacgtaaacagaagagagagagagagagagaaatcacagtagtgaggctaacaaaaataatgataaaaaggttagaagaacccaggatacttagtggatgcctagacaacataaaaatagatttatagaaggaagcaatggaatttgaatataaaagggtatcagaaagttaatgtgttgcatctgaaattcaaagtatttccttttggctacacaagaaagacttttaataaaaccctttgtatatatttctgaaaggtaaatattttatagggaaatggaggattggaagaaaatctgttccatcatgtctgggtattagaattttgcttaataacttgccaaaatattacgcttccaagggctatggcattatgtgtgtacccaattaaag

SEQ ID NO: 8900 - DNA, 606 bp, Homo sapiens
  misc_feature (1)...(606): n = g, a, c or t
ctgtcaccaggccagaaacaaaaagaagagcctaaggaagtgaagctcagtgttcccatgccctacacactcaaggtgcactacaagtacacggtagtcatgaagactcagcccgggctcccctacagccaggtccgggacatggtgtctaagaaactggagctccggctggaacacactaagctgagctatcggcctcgggacagcaatgagctggtgcccctttcagaagacagcatgaaggatgcctggggccaggtgaaaaactactgcctgactctgtggtgtgagaacacagtgggtgaccaaggctttccagatgaacccaaggaaagtgaaaaagctgatgctaataaccagacaacagaacctcagcttaagaaaggcagccaagtggaggcactcttcagttatgaggctacccaaccagaggacctggagtttcaggaaggggatataatcctggtgttatcaaaggtgaatgaagaatggctggaaggggagtgcaaagggaaangtgggcattttccccaaagtttttgttgaagactgcgcaactacagatttggaaagcactcggagagaagtctaggatgtttcacaaac

SEQ ID NO: 8901 - DNA, 95 bp, Homo sapiens
  misc_feature (1)...(95): n = g, a, c or t
ctggtttntaattctaatantataaaaattggaaatttgaaatagttctgtaaaagaaaaaaatgtaaaaatacatctgctttctctnatggttt

SEQ ID NO: 8902 - DNA, 448 bp, Homo sapiens
ctggagagtgtagatcccaaaattacccaaagaagaagatggaaaagcgatttgtcttcaacaagatagaaatcaataacaagctggaatttgagtctgcccagttccccaactggtacatcagcacctctcaagcagaaaacatgcccgtcttcctgggagggaccaaaggcggccaggatataactgacttcaccatgcaatttgtgtcttcctaaagagagctgtacccagagagtcctgtgctgaatgtggactcaatccctagggctggcagaaagggaacagaaaggtttttgagtacggctatagcctggactttcctgttgtctacaccaatgcccaactgcctgccttagggtagtgctaagaggatctcctgtccatcagccaggacagtcagctctctcctttcagggccaatccccagcccttttgttgagccagg

SEQ ID NO: 8903 - DNA, 603 bp, Homo sapiens
  misc_feature (1)...(603): n = g, a, c or t
cctttattgatttaattttcctttcaacttatcaatgctatcacaaattctaaggaaacaggacttgggcaaaattttttattatgaagatacagatctaagaacagaaggataattatgtgctagcttatatatagttccttgtaaaaataatgatacatgaaaaattagtagaaaatgaaaatctgcagttatctgatatctgaaaatgttaagcaatttcccctgcatcttagttctaatcacttttgcagaataatcaagcatatttgggtgaagagagtatttaatgattccatttttattaatagtgtagtgtgcccttcagagcttggcgtagtctttaagaatcatctgaagtttctggctcagcatgatgttccctctggccttcagcctgccactaaagaatgccttctgagggtcaagcttgcccaggaccacctccatgaaatcttcatctgaaagtatgattgntgtatcagcagcaccttttgcagggccttggtacacttttccagaaccacttttcaggtcaatagtccacttagccccaatatttccgcctttggttatatgccactcaaatacagcatttacacc

SEQ ID NO: 8904 - DNA, 324 bp, Homo sapiens
cctgtatagaacaacaatttgattctctcaatggaggagtatctgtgtcaaaaaatagtacttttgctgaggaatttgcacatagtattcggtcaatttttgcaaatgtagaagccaaacttggagaaccttctgaaattgaccagagagacaagtatgttggaatttgtggactctttgtattgcactttcagatttttcgaactattgataaaaagttttataagtctttattggacatttgtaagaaggtaccagccatcactctaactgctaatattatttggtttcctgataattttctgatccagaaaataccagcag

SEQ ID NO: 8905 - DNA, 200 bp, Homo sapiens
tgtgtctaggaaatagggcaggagtgggcgctgaggaggagtatgtcctcccagttaccttgagatctgccacagtgaggtttctatggcataccagagaatggaaagaagattaggttggcacttcctacttctgataccatcttcacggcttcattaggtgcccccaatttccacagaatctgaagttctgggcaagg

SEQ ID NO: 8906 - DNA, 564 bp, Homo sapiens
  misc_feature (1)...(564): n = g, a, c or t
ctgcttgcacaaatggatgttagtatgggaggaagagtggcagaggagcttatatttggaaccgaccatattacaacaggtgcttccagtgattttgataatgccactaaaatagcaaagcggatggttaccaaatttggaatgagtgaaaagcttggagttatgacctacagtgatacagggaaactaantccagaaacccaatctgccatcgaacaagaaataagaatccttctaagggactcatatgaacgagcaaaacatatcttgaaaactcatgcaaaggagcataagaatctcgcagaagctttactgacctatgagactttggatgccaaagagattcaaattgttcttgaggggaaaaagttggaagtgagatgataactctcttgatatggatgcttgctggttttattgcaagaatataagtagcattgcagtagtctacttttacaacgctttcccctcattcttgatgtggtgtaattgaagggtgtgaaatgctttgtcaatcatttgtcacatttatccagtttgggttattctcattatgacacctat

SEQ ID NO: 8907 - DNA, 593 bp, Homo sapiens
caggagggttgtctggagccaccaggttgcaatttgaggcagcagtagtgagggaaatggtatgagaagatttgtagatgttatgaggcagcatcttttgtgacatattttctcattttaggttttgaaaatagtgaagtactccctgaaaacacacaccaaataatgaactataaaaatacttggattatgaatatattttagtggcttctcttttctttttattataatgtatttttttctcatgcatactccatatcttgcttgtgttcaagcatactttaatttttaattcatcagttaagctgtctttgagttaccatgatattgggcatacctcattattttttacaccaaatgcattttaaaaaggaaaaaggacactgttttatcttctttcttgctgctttaatgaggatggagggataagttacaggctggcacattaaatgtactactatggaaggacctttttctttatcagtgtcccttccctacccttaaaatcactgatcagggtctagcagtatctgctcctcaaaacttgggaccaagtgatggtgttcccacttgcaatgtcctctcatagcact

SEQ ID NO: 8908 - DNA, 381 bp, Homo sapiens
ctcagtgttcatcagtgaagcgttctgggcacggccatgcccggctttcacatgttgtctgtgctgttctcactccagtgggagagcggagtagtcgccacagagagcacctggcccgcacagcctgttctgcattttacagaagtttcccaactcttgctttgttacatgcaaagtctagaaaggataaatgcaaaatattagcaggtgatgttgtgaagtttcctttttcttttcttttttttttttcctccttgatagagtgtcactctgtcacccaggctggagtgccgggcgtggtagttgacgcctgtaatcccagcagtttgggaggccgaggaggatggatcacctgaggtcagaagttcgaaaccagcctgg

SEQ ID NO: 8909 - DNA, 603 bp, Homo sapiens
ctggaggtgtaatagtgcgggtagtgggtttggagaagttccgaggcggcggtggcgccggtcaggacaaggatagcggaaccgggccctgggcttgtcgctcaccatgccgacagtagaggagctttaccgcaattatggcatcctggccgatgccacggagcaagtgggccagcataaagatgcctatcaagtgatattggatggtgtgaaaggtggtactaaggaaaagcgattagcagctcaatttattccgaaattctttaagcattttccagaattggctgattctgctatcaatgcacagttagacctctgtgaggatgaagatgtatctattcgacgtcaagcaattaaagaactgcctcaatttgccactggagaaaatcttcctcgagtggcagatatactaacgcaacttttgcagacagatgactctgcagaatttaacctagtgaacaatgccctattaagtatatttaaaatggatgcaaaagggactttaggtgggttgttcagccaaatacttcaaggagaggacattgttagagaacgagcaattaaattcctttctacaaaacttaagactttaccagatgaagt

SEQ ID NO: 8910 - DNA, 549 bp, Homo sapiens
cactaaagcatagtacgtggatgtcagtgagacagcatgagagccagcagtcatcaaagcgttccacgtttgaagttagcaactgcttaaagttatgccctattaaaattgctttctcaaaagtttgggttagtttcaaatgtgatattttggagggaaggtaaagtaggtatctttcaggtcgtgataatgagctcctatgaaaggatgcaatataatgacccgcttttctagaaagttcataatcagctctggaacaagcacacttgattcctcactgtgcttcagaatgagattaagatcagatgttggaacgtgctatgctgtagcgtgtctggaaacaaagtacacaaacctggctacggtgatgagttagcttctgcttactacctgtgacaacccaagtgggtgacactagtgaaccttctccagtctgcaggctggcatagaaggctcttagattatattgggcagcttgcaatctgccgaagcagtgacttgcatttccacacttggcttgagcactcaacccagaaggcgaagatagct

SEQ ID NO: 8911 - DNA, 437 bp, Homo sapiens
ccttaattttctgttcatggactgttaaaagtaaaaccaaactttcaaaagggataaacctaaatatttacttgttatcattagagagggaacatcaaatgctgggacatcattactaaccaatagcatcagacactggatttaatggataatcacaatggtcgtaatgtatacagacatatataccacgttctagtataaatttttcaaaaaatacaataataatataatttataaagaacactcttctatgaacaaccaccaccaccaaaaaagaaaaagccctcagaaaatttctcacaaataaggcaactaatgcctgatatctcaaaatcctttacaaaaggagatagttctagtcaaggagttttgggtatgttacttttttttcttctttttcttttcatctgcctccatcttaagtgcaatttcttcag

SEQ ID NO: 8912 - DNA, 595 bp, Homo sapiens
  misc_feature (1)...(595): n = g, a, c or t
cctacttcacaaagcgccttcccccgtaaatgatatcatctcaacttagtattatacccacatccacccaagaacagggtttanaaaaaaaaaaaaaaaaaaaaaaaaaaagcttgtacaaaaaatgggngcgctgcantccagacagnaatttntgcaaactgncttgnanaaaaaggaccaatgttcgaactacttccaggtgaatccaacaagatcccccgtctgaggactgacctttttccaaagacgagaatccaggacttgaatcgtatcttcccactttctgaggactactctggatcaggcttcggctccggctccggctctggatcaggatctgggagtggcttcctaacggaaatggaacaggattaccaactagtagacgaaagtgatgctttccatgacaaccttaggtctcttgacaggaatctgccctcagacagccaggacttgggtcaacatggattagaagaggattttatgttataaaagaggattttcccaccttgacaccaggcaatgtagttagcatattttatgtaccatggttatatgattaatcttgggacaaagaattttatagaaattt

SEQ ID NO: 8913 - DNA, 597 bp, Homo sapiens
ccaaaagaagtaagacagcttgctgaagatttcctgaaagactatattcatataaacattggtgcacttgaactgagtgcaaaccacaacattcttcagattgtggatgtgtgtcatgacgtagaaaaggatgaaaaacttattcgtctaatggaagagatcatgagtgagaaggagaataaaaccattgtttttgtggaaaccaaaagaagatgtgatgagcttaccagaaaaatgaggagagatgggtggcctgccatgggtatccatggtgacaagagtcaacaagagcgtgactgggttctaaatgaattcaaacatggaaaagctcctattctgattgctacagatgtggcctccagagggctagatgtggaagatgtgaaatttgtcatcaattatgactaccctaactcctcagaggattatattcatcgaattggaagaactgctcgcagtaccaaaacaggcacagcatacactttctttacacctaataacataaagcaagtgagcgaccttatctctgtgcttcgtgaagctaatcaagcaattaatcccaagttgcttcagttggtcgaagacagaggtgcaggt

SEQ ID NO: 8914 - DNA, 576 bp, Homo sapiens; identical to SEQ ID NO: 8798

SEQ ID NO: 8915 - DNA, 435 bp, Homo sapiens
ctggagcccttccctgagaaactcttacaggccaggaagccagtacagatctttgagaggtctgtgtacagtgacaggctccactttgaggctctgatgaacattccagtgctggtgttggatgtcaatgatgatttttctgaggaagtaaccaaacaagaagacctcatgagagaggtaaacacctttgtaaagaatctgtaaccaataccatgaagttcaggctgtgatctgggctccctgactttctgaagctagaaaaatgttgtgtctcccaaccacctttccatccccagcccctctcatccctggagcactctgccgctcaagagctggtttgttaattattgttagactttgccattgttttcttttgtacctgaagcattttgaaaataaagtttacttaagttatgcttgtttttctaaaaaaaa

SEQ ID NO: 8916 - DNA, 450 bp, Homo sapiens
  misc_feature (1)...(450): n = g, a, c or t
gctgcctgtatctttcatttttaaaatagcacttgagttattttctgagtaatccaataaagaacttttgatgacagccagaatgtgttagaactctggctgaacatttcatctcctgtgagtcagaagggctttatttctccctttgatggggccccttcttctttctggtgctctggaagttgtttagaggaaagaattctaattttaattaattgcgcagtgagttaatctcactcgcttttctgcttccaggcatcttaggaaaaacaaatggttttagtagataagggatgcctactaatgcttttttaaaacaaacagggacatttttattatagatttgatttttttaatgaatgtttttaaaaatatataaataggacaccaaagcggcagggttttttttggggggagggggtttgttttccaactcangatggcacatta

SEQ ID NO: 8917 - DNA, 605 bp, Homo sapiens
  misc_feature (1)...(605): n = g, a, c or t
ccttggtcctagcacccactcgagaattggctcagcagatacagaaggtggtcatggcactaggagactacatgggcgcctcctgtcacgcctgtatcgggggcaccaacgtgcgtgctgaggtgcagaaactgcagatggaagctccccacatcatcgtgggtacccctggccgtgtgtttgatatgcttaaccggagatacctgtcccccaaatacatcaagatgtttgtactggatgaagctgacgaaatgttaagccgtggattcaaggaccagatctatgacatattccaaaagctcaacagcaacacccaggtagttttgctgtcagccacaatgccttctgatgtgcttgaggtgaccaagaagttcatgagggaccccattcggattcttgtcaagaaggaagagttgaccctggagggtatccgccagttctacatcaacgtggaacgagaggagtggaagctggacacactatgtgacttgtatgaaaccctgaccatcacccaggcagtcatcttcatcaacacccggaggaaggtggactggctcaccgagaagatgcatgctcgagatttcactgnatccgccatgcatgga

SEQ ID NO: 8918 - DNA, 597 bp, Homo sapiens
  misc_feature (1)...(597): n = g, a, c or t
ccaacattgcgaaaccctgtctctactaaaaaaaaaaaataaaaaatacaaaaattagctgggtatgatggcacatgcctctaatcccagctactgggaggctgaggcatgagaatcgcttaaacctgggaggcgggtttgcagtgagccaagatagcaccactgcactccagcctgggtaacagattgagactctgtcaaaaaaaaaaaaagatgttaaaggaaaaatctgaggcgcaattcatgaagtttagtgttccagtggcaaaatgtcacaggcaagtatttattgggaaaatgtggaagcaaaataaaggcaatcggttggttttcaattacataattgttttttgggggtaggtatcttcttanaaagtccctagtcacctaattatatgttagtaggctgcttgtgattggctggggttgtcttatttctaacataagcatttaccanaaatgatccaagttaagttttgcttatgcttgtatgtagtatgaccccgtgaagttttgcttgngtttgtagtttaagcaaagttaaagctatttctaagggccaggtggttttgtttgctcaggatttttccagtctcc

SEQ ID NO: 8919 - DNA, 570 bp, Homo sapiens
  misc_feature (1)...(570): n = g, a, c or t
gctagactaagttggtcatgatgcanaagctactcaaatgcagtcggcttgtcctggctcttgccctcatcctggttctggaatcctcagttnaaggntatcctacgcagagagccaggtaccaatgggtgcgctgcaatccanacagtaattctgcaaactgccttgaagaaaaaggaccaatgttcgaactacttccaggtgaatccaacaagatcccccgtctgaggactgacctttttccaaagacgagaatccaggacttgaatcgtatcttcccactttctgaggactactctggatcaggcttcggctccggctccggctctggatcaggatctgggagtggcttcctaacggaaatggaacaggattaccaactnntanacgaaagtgatgctttccatgacaaccttaggtctcttgacaggaatctgccctcagacagccaggacttgggtcaacatggattagaagaggattttatgttataaaagaggattttcccaccttgacaccaggcaatgtanttagcatattttatgtaccatgggtatatgattaatcttg

SEQ ID NO: 8920 - DNA, 225 bp, Homo sapiens
cctttcctctgcaggttggagaacacagcgcgcgaccatgaacgcttccttttgtacgtctgcggcatggtgtccttcgtgagcacagcatagggacctggaaacgtgtcttggaactgatgctgaactgaatttcttgggttcgagtttaagggactctggattgcagaagcctcgttaatgggatctagagatgcgaagaactggccggccgagggctgcagg

SEQ ID NO: 8921 - DNA, 600 bp, Homo sapiens
  misc_feature (1)...(600): n = g, a, c or t
canagagccaggtaccaatgggtgcgctgcaatccagacagtnattctgcaaactgccttgaagaaaaaggaccaantgttcgaactacttccaggtgaatncaacaagatcccccgtctgaggactgacctttttccaaagacgagaatccaggacttgaatcgtatcttcccactttctgaggactactctggatcaggcttcggctccggctccggcntctggatcaggatctgggagtggcttcctaacggaaatggaacaggattaccaactagtagacgaaagtgatgctttccatgacaaccttaggtntcttgacaggaatctgccctcagacagccaggacttgggtcaacatggattagaagaggattttatgttataaaagaggattttcccaccttgacaccaggcnatgtagttagcatattttatgtaccatggttatatgattaatcttgggacaaagaattttatagaaatttttaaacatctgaaaaagaagcttaagttttatcatccttttttttctcatgaattcttaaaggattatgctttaatgctgntatctatcttattggtcttgaaaatacctg

SEQ ID NO: 8922 - DNA, 501 bp, Homo sapiens
ccattgctagttggacgtcggaaggaaaaaaatgttcaaggtataattgaaatcctcaaaggaatgcaagaattgggagtacatcctgatcaggaaacatatacagattatgtgattccatgctttgatagtgtaaactcagcacgagccattttgcaggaaaatggatgtctgtctgatagtgatatgttttctcaagctggattgagaagtgaagcagcaaatgggaacttagactttgtattatcatttttgaaatcaaatacattgcccatctcgctgcagtctataagaagtagcctactgctaggcttcaggaggtctatgaatataaatctttggagcgagataacagaattgttgtacaaggatggacgttattgccaggagcctcgaggaccgacggaagctgttggctattttctttataacttgattgacagcatgagtgactcagaggtacaggccaaggaggagcatttgagacaatacttccatcag

SEQ ID NO: 8923 - DNA, 604 bp, Homo sapiens
  misc_feature (1)...(604): n = g, a, c or t
ctggcaatgacaagactgggagtatcaaactaggattgttagttcaattaaaatttcagataaacaataatgtacttatactaaaaaattatttgttgtttatctgaaatgaaaatttaactgggtacccaattgtttgtttgtttaatctaaaaaccctgattgaaatttatctaataaaacatcatttaatatctaaaataaaataaatttactataacatctttataactattcaatcaatgattcatcttctatttttccaaattcttgcacaaatatttgatgcttaaataaatacataaataataaataggttaataagttacacttgaaaataatttatgttatgatgaaaaaacttaaagtgcttccacatgtcctcacaacatcactgtgaggtaagatggtggctaatactttttccacttagaaataaaggagaaaccaaggcacagtggaacaaggacttgtggatcctggctagcagactagggttgccagatttaacagaaaaaaatccaggatttccagctaaatttgactttatggcaaaatttattgncccatcatttttatgtgatgcttcaaatatcacattcta

SEQ ID NO: 8924 - DNA, 577 bp, Homo sapiens
ccaagggcagtttgctggatttcctgaagagcaatgaaggtggcaaagtgctgcttccaaagctcattgacttttctgctcagattgcagagggaatggcatacatcgagcggaagaactacattcaccgggacctgcgagcagctaatgttctggtctccgagtcactcatgtgcaaaattgcagattttggccttgctagagtaattgaagataatgagtacacagcaagggaaggtgctaagttccctattaagtggacggctccagaagcaatcaactttggatgtttcactattaagtctgatgtgtggtcctttggaatcctcctatacgaaattgtcacctatgggaaaattccctacccagggagaactaatgccgacgtgatgaccgccctgtcccagggctacaggatgccccgtgtggagaactgcccagatgagctctatgacattatgaaaatgtgctggaaagaaaaggcagaagagagaccaacgtttgactacttacagagcgtcctggatgatttctacacagccacggaagggcaataccagcagcagccttagagcac

SEQ ID NO: 8925 - DNA, 467 bp, Homo sapiens
  misc_feature (1)...(467): n = g, a, c or t
ccactagctgaatcttgacatggaaggttttagctaatgccaagtggagatgcanaaaatgctaagttgacttangggctgtgcacaggaactaaaaggcangaaagtactaaatattgctganagcatccaccccaggaaggactttaccttccaggagctccaaactggcaccacccccagtgctcacatggctgactttatcctccgtgttccatttggcacagcaagtggcagtgtctccaccacctatgatggtgatgcagcccctagaagtggctttcaccacctcatccatgagagctttggttccccgggcaaaagcttcccattcaaatacccccacaggaccattccacacaatctgcttagcccgagtgacagcctcagcatacttcttgctgctttcaggaccacagtccaagcccatccagccagcaggtatgccagaagccacagtggcttgg

SEQ ID NO: 8926 - DNA, 478 bp, Homo sapiens
ctgaaccctcgtggagccattcatacaggtccctaattaaggaacaagtgattatgctacctttgcacggttagggtaccgcggccgttaaacatgtgtcactgggcaggcggtgcctctaatactggtgatgctagaggtgatgtttttggtaaacaggcggggtaagatttgccgagttccttttactttttttaacctttccttatgagcatgcctgtgttgggttgacagtgagggtaataatgacttgttggttgattgtagatattgggctgttaattgtcagttcagtgttttaatctgacgcaggcttatgcggaggagaatgttttcatgttacttatactaacattagttcttctatagggtgatagattggtccaattgggtgtgaggagttcagttatatgtttgggattttttaggtagtgggtgttgagcttgaacgctttcttaattggtggctgcttttagg

SEQ ID NO: 8927 - DNA, 605 bp, Homo sapiens
ctgggaagccacgagaatattgtgaacctgctgggggcgtgcacactgtcaggaccaatttacttgatttttgaatactgttgctatggtgatcttctcaactatctaagaagtaaaagagaaaaatttcacaggacttggacagagattttcaaggaacacaatttcagtttttaccccactttccaatcacatccaaattccagcatgcctggttcaagagaagttcagatacacccggactcggatcaaatctcagggcttcatgggaattcatttcactctgaagatgaaattgaatatgaaaaccaaaaaaggctggaagaagaggaggacttgaatgtgcttacatttgaagatcttctttgctttgcatatcaagttgccaaaggaatggaatttctggaatttaagtcgtgtgttcacagagacctggccgccaggaacgtgcttgtcacccacgggaaagtggtgaagatatgtgactttggattggctcgagatatcatgagtgattccaactatgttgtcaggggcaatgcccgtctgcctgtaaaatggatggcccccgaaagcctgtttgaaggcatctacaccattaagag

SEQ ID NO: 8928 - DNA, 605 bp, Homo sapiens
ctggtggaagctctctgaagaactgagacaggaggtggcactgctctgacaccatcctttgaaggtgacagagcatctcagggcttgggggacgccagccggactttgagaggagacagaagaggtgcttgcagaggtatttcacaaagatcagggtctcggcccaaaagttgacttctgctttttcaaacaggtagtcttcttccacctgatgcatgctctccacacaggccacgaggtcatcactctctcccaacagccatcccagcaggatgggcagtccaggggccaactggtcccactgctggagcagatcacacaggacggccagggccagggccagagcgatggaggcatccacctggcagaaggcaaactctgttgactggcaggtattttcttgtgacatggcagttgtcacggtttccgtggctgcatctctaacagcttgctcctcactctgcagaagggtaaggacacacttccagagagcaagtgtatcctgcaactcaagaataggatgggggttggtgaggaaaagtggtgtagtactggtgaggacttcaacgacggccagcctagactctgtaggaagatggtcttca

SEQ ID NO: 8929 - DNA, 598 bp, Homo sapiens
ctgctgaaccctttagggcatttcctctgtaatgtggcgctttcaactgtactgctgcagctttaagtaccttaaagcttctcctgtgaacttcttagggaaatgttaggttcagaactaaagtgttttgggtgggttttgttgcgggggggagggtaacaatgggtggtcttctgatttttatttttgaggttttgtcaactggagtacgtagaggaactttatttacagtactttgatttggcaggttttcttctacttgtgctctgcctggagctgtttccatatgatataaaaagcaagtgtagtattccattactatgtggcttagggatttatttgttttttaaaatcaaccatgttagctgggattagactccctacagtccttcaatggaaaagtaacatttaaaaatcctttgggtaattcaaattacagatttaaaagagcttaagatctggtgttttgttaatgcttctgtttattccagaagcattaaggtaacccattgccaagtatcattcttgcaaattattcttttatataactgaccagtgcttaataaaacaagcaggtacttacaaataattactggca

SEQ ID NO: 8930 - DNA, 597 bp, Homo sapiens
ctgaatttcacttttctttaaaaatttaatattaaaatgttttcatctcttaattgttggcttgcttgcatggatcattcattaaataattttttatttgctagatacccataatatctgccgaacatctgactagccacaagtatgttacccagatgtagaattttcatcactaaacagtaagttcattatgtaatatatagttgcatatttgtggtggttttttttaagatagcaattgtatagtgcacttaaaattttgcgaaatctctgagaaaatatatacagatcacatttttatcttaaatgggtgtgaggaattttatcagacatctttataacaaatatgttaatatcacttaaatatacaaagtactaagagaaaataaattttttaaatttctgattagagataaacacagcataaagaaaatgtatgaccaaaaagtaattagaaggtatagatcaagggttggcaaactttcttatagggtcagacagtaagtatttttgctgtgtgggccgtatcgtttctgttgcagctactctcctctgccattgtatcatgaaagcagccagagaccacatgtaaacaaa

SEQ ID NO: 8931 - DNA, 576 bp, Homo sapiens; identical to SEQ ID NO: 8798

SEQ ID NO: 8932 - DNA, 305 bp, Homo sapiens
ccttgctcggagtcccaggagatccacaggtccggcatgaacagtgagaggtcagaggtggaaggctcagcaggagaggagaggaggatcagcagaggtcatgagaaggccagaatccagggtcaggctgtcctggtcgaagttgagtttcttagctggaggagtttctcctagcccttcaatatccaccacgtcactgttggcatcggagtcgttcagagcactgagtgtcacatcagccttctgtttctttatggggggacccccggcctcagggacactggagctgctgggaggaggggcag

SEQ ID NO: 8933 - DNA, 401 bp, Homo sapiens
ccgcgccggtgagtagcactctctgagagctccaatttcatccgtctgccatcggcgccatcctgcaatctaagccacaatggtgcgcatgaatgtcctggcagatgctctcaagagtatcaacaatgccgaaaagagaggcaaacgccaggtgcttattaggccgtgctccaaagtcatcgtccggtttctcactgtgatgatgaagcatggttacattggcgaatttgaaatcattgatgaccacagagctgggaaaattgttgtgaacctcacaggcaggctaaacaagtgtggggtgatcagccccagatttgacgtgcaactcaaagacctggaaaaatggcagaataatctgcttccatcccgccagtttggtttcattgtactgacaacctcag

SEQ ID NO: 8934 - DNA, 593 bp, Homo sapiens
aaggctaccatgccggatctgtaaatgaacctgttaaatgctgtatttgctccaacggcttactatagaatgttacttaatacaatatcatacttattacaatttttactataggagtgtaataggtaaaattaatctctattttagtgggcccatgtttagtctttcaccatcctttaaactgctgtgaatttttttgtcatgacttgaaagcaaggatagagaaacactttagagatatgtggggtttttttaccattccagagcttgtgagcataatcatatttgctttatatttatagtcatgaactcctaagttggcagctacaaccaagaaccaaaaaatggtgcgttctgcttcttgtaattcatctctgctaataaattataagaagcaaggaaaattagggaaaatattttatttggatggtttctataaacaagggactataattcttgtacattatttttcatctttgctgtttctttgagcagtctaatgtgccacacaattatctaaggtatttgttttctataagaattgttttaaaagtattcttgttaccagagtagttgtattatatttcaaaacg

SEQ ID NO: 8935 - DNA, 579 bp, Homo sapiens
  misc_feature (1)...(579): n = g, a, c or t
ccaacatggtgaaaccccatgtttactaaaaatacaaaaattagccaggcatggtggtgcatgcctgtaatcccagctactggggatctgaggcaggaggatcgcttgaacccaggaggcagaggttgcagtgagctgagatcatgccactgaactccagcctgggcaacagagagactccgtctcaaaaaaaaaaaaaaaaaattcatcaaggtatatacatatacattcagattagtgtacatgtaaaatatgatatacaacagagcctttcatgaataggataatttgcatattcatatggaaaacatatgcagtatcttaagccatagttttccaaaatttcaaattaaatacttatagctttgacatattcctgttacttcaactttccagggatgctctagaagaaacgggagacatgttgtaagactttaatgacattccacaaactaaatttattgngggaattaacatcagaaattaagggaaaaaatactctaatttgatcactagctgctacatggtccactttctagggagtcttgnatatttttttcacaattctgtttgctaagt

SEQ ID NO: 8936 - DNA, 487 bp, Homo sapiens
ccacaggtcctgcctagacacacatcaatatgaaacaaaaaaaatttatataaataagtcaattaaacttcacaaaaactaaagaaacacaagacaaaaatccaacaagcaataaaaactgtacaatattggtcagtcttttatatctgaaaaatgtgtaacttaaaaaaaagttatttatcgtataaaaaaaagtcttttacatctgtgttagctggagtgaaaacttgaagactcagactcagtggaaacagatgaatgtccacctcgctttcctttggagaggatcttgaggctggaccctctgctcacagaggtgagtgcgtgctgggcagaggttttaaatttggctccaaggaaagcatagaggatggggttcagacaacagtggaagaaagctagggcctcggtgatggaaatccacttgtgcacagtgttctcaaactcacacccttgcttgatgatttccaggaggatgaaggagtcg

SEQ ID NO: 8937 - DNA, 608 bp, Homo sapiens
ccacgaagcaccgccaggacagttttcaaggaagagaaagtaaagggtctccaaagaagcggctggatgtccgtctgtcgagaacgtccagcgtggagcggggcaaggagagggaggaggcttggagctttgacggggcattggagaacaagcgaactgccgctaaggaatctgaggagaacaaggagaacctgatcataaattctgaactcaaagacgacttgcttttgtatcaggacgaggaggcgctgaacgactccattatttctggaacactgccacggaaatgcaagaaggagctcctggccgtgaagctaaggaaccggccaagcaaacaggaactagaagaccggaacattttccccagaaggactgatgaagaaagacaggagatccggcagcagatcgagatgaagctttccaaacggctgagccaaagacctgccgtggaagagctggagagaagaaatatcttgaaacaaaggaatgatcagacagagcaggaagaaagaagagaaatcaagcaaagattgacaagaaagcttaatcagagacccactgttgatgaattaagagacagaaaaattctgatacgattcagtgattac

SEQ ID NO: 8938 - DNA, 383 bp, Homo sapiens
ccaggcattaaacttagtaacattaagtacactttagtactacagcagtcaaagagatctccactagagatcagaaagaagcaccactattttcttctatgacgtgtatgtgttggtcatgagcatgctagtatgaataaggcaatgtgttaagcactggcatacaaatgcagctaaaggtgctgaaggaaggcagtggggtggtgcaggcacacagcagggagctcttccccgtgacacgttagtcatcttctccacagagcaacagaagagctttcttatagtccccagatgtatctcccttaatcatggaataaagagaggtggcaaaattcttcctaaactccttcctgatgttaaacagatcaatctcactcctggaa

SEQ ID NO: 8939 - DNA, 604 bp, Homo sapiens
  misc_feature (1)...(604): n = g, a, c or t
ccacagaacagtccctttttgagtaaagcagcaaggttgcttaatgacatgctatgtggttaacaagattcaactgccacatcaaggactttaaataatttcaagattttaaatgtatttatgaaatgaactcattacagcagctaatcaatgcaaactttgtcctttttctttgtctttctaagagaaactgaatttaatttaaatttaaattacagtgtctaaaacttggtaaaatattttaaatttgaataagaggaaaaaaaaaacatgaatttatttatgatggagcttcatacccaggacagtagcttcttaaatgttagtaaaataattatgttaagcattaaaacaattttgaatatgtaattaagcatttatgttaaaaaacatgtttcttacgtgtgtgtgtatatatttataactgacacatgtgattctttgtacagtatttagaatccttcccttcagatagcagtcctcttgtattcagtcttgnggctaaaatagatcaaaaacatattttaaaactgttaaagtaactgtatgactcatgcttgaagttctgaaatttgggagcgttatgaggtttccatgccattaa

SEQ ID NO: 8940 - DNA, 279 bp, Homo sapiens
ccaccaccacgtcgatgcggtccactgagaaggggttgaactgcttgtccggccggcgcatgaactcatgcttgaggaggtagccgctctgcccgttgaactcaaatactgccatgttctgctgcatgggcaagtccatcgtctggaagttgagggcaaccatctggcatccagcattccagaacatctggggcatgtagttggaggagtccatgcgggttcccttggggtaaatgcggctcatctggcgcttgttgtagtccacaaactgcaccgagg

SEQ ID NO: 8941 - DNA, 234 bp, Homo sapiens
ccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgagaaaaaaaaaaaaaaaaaaa

SEQ ID NO: 8942 - DNA, 438 bp, Homo sapiens
ctgggaaaatgaagggaatcatggtcaaatccttggagggacagaaggaaggcaatgggagaaaccagccagcctgggttttcaataccaactcacatgcaaggtaacccaagcctcatcctctgatctgtaaattggggcaaatgtgaattatttcccttgttgaaaaatatttaaaagatgagggtaggtggaacgtgaacatatgtgtgttttaaacttactgtagcttattgataggaattacagttctggcaaatttcccaaaacctgtagtaataccgtaaacaactaggataaaaagagacattatgcaattaaatgcagggatttttgtttgtttataaaaatatttataacataaagataaaaagatacctgttttctcttttatgatgctatctatgacctccctggatttctgcaccctcttctcag

SEQ ID NO: 8943 - DNA, 573 bp, Homo sapiens
  misc_feature (1)...(573): n = g, a, c or t
ccaggctggtcttgaactcctgaccccaggtgatccactcgcctcggcctcccaagtgctgggattacagacgtgagccaccacgcctggctcactttattttattgatgaagagccccaaacactgggtgggaaggggacttaaggccactcagctcatcggtgggagagacgggacaccttttccatcccacgatgcctcatagaaccgggagagagtggaggacgctaagtgtagaaaactctgttaaggagcttggtgctcgggtgagaatggaggcagcagagcactttgggaaggggcaagagaaagaggacagttctagaaagacagttctttcaagatagcccgttggagatgcctggcaggaaatgggcactcaaggctggagatgcatctttagatgtggagtcttaggattaggtggaagcagaagacctgagcatgtctgggctttcacacgaaggatgagaagagacgaggatggaattccagggcacaccaaccatgaatgggcnngncaaaggaaaaaccgccagcaaaggagaccaagaaggtgataaaacagactt

SEQ ID NO: 8944 - DNA, 591 bp, Homo sapiens
  misc_feature (1)...(591): n = g, a, c or t
ccaaagaccaaattccttggcatgccttccagcaccctgcaaaatgagaccctcgtggccttccccagcctcttctagagccgtgatgcctccctgttgaagctctggtgacaccagcctttctcccaggccaggctccttcctgtcttcctgcattcacccagacagctccctctgcctgaaccttccatctcgccacccctccttccttgaccagcagatcccagctcacgtcacacttggttgggtcctcacatctttcacacttccaccagcctgcactactccctcaaagcacacgtcatgtttcttcatccggcagcctggatgttttttccctgtttaatgattgacgtacttagcagctatctctcagtgaactgtgagggtaaaggctatacttgtcttgttcaccttgggatgatgcctcatgatatgtcagggcgtgggacatctagtaggtgcttgacataatttcactgaattaatgacagagccagtgggaagatacagaaaaagaggggctgggctgggcgcggtggttcacgcctgtaatcccagcactttgggaggccaaggagggnggatcac

SEQ ID NO: 8945 - DNA, 266 bp, Homo sapiens
  misc_feature (1)...(266): n = g, a, c or t
tgattgtagctatgttggtgtatctcgtgtncaagatggaaaagtgcttttgttgttctacctgatccagttgggggagcaggaatagggggtgcctgcctaacggcctctagcccatgtgcttatactgggatctgncccgagggatctgcacctggttggcagtcattttgtggtggacgtggtaaatcgcgagtgttaccatgatgacgaggcccannatgagccccaaaatcaggggcanggtttcttccanttgctcccgc

SEQ ID NO: 8946 - DNA, 460 bp, Homo sapiens
  misc_feature (1)...(460): n = g, a, c or t
agaaaggaataagctattaatacatgccacaacctagatgaatctcaaaataattatgctgaatgaaaaaagcagaagaaatatttgaagtaataatgactcagagtttcccccaaatgaacgtnagataacaaaccacagatccaggagaacactaacaggaaaaatatcccccaaaatatatcaaggcatatcatatttaaattgcagaaaatcaaagataaatacaactctgaaagtagccagaggaaaaaactttacccacacaggggctaagataataattatgtctgactacgcctcaggagccatgaaagcaagaaaagagtccggagaaatatttaaagcattgacagaaaaaaaaataccaccaacctagaattctggtaccctgggaattgcctcaaaagtaaagaataaatactttctcagacaaacaaaaattgagagaatttgtcag

SEQ ID NO: 8947 - DNA, 572 bp, Homo sapiens
  misc_feature (1)...(572): n = g, a, c or t
ctggtcaagaggctcacatctgcagaggtgccaatggccacagacaggctgctctctgagggttctgttggnggagaatctgaaggctgcagatcctttctagatggaagcttagaggatgcttttaatgggcttttacttgcattagaaccacataaagagcagtataaagagtttcaggatctgaaccaagaagtcatgaatttggatgatattctaaaagatgctaaacaccttgacgatcagaaactaantggtgctgcctcttggacggagatcactgagggtgaatganacaactgtgatttaaaagaccgaaagacgttttcccatgtgcttttgtgccatcttgagtgtcagagacagatccctgcaaggcccttcctaccttgcgctaagaaatcagcaaggagtgtcacctaactggatggaggacatttagtgcttctaacttgcagaatttgtcccattcgacccaccccagcatcctcttgaatatttggaaatacttctctccaactctgtgcccatagcaactggcattgttttgcttgtaatgtttctgcatgtgg

SEQ ID NO: 8948 - DNA, 381 bp, Homo sapiens
  misc_feature (1)...(381): n = g, a, c or t
ctggatctncaatgcagncgattgttcctccaaaggccaagtaccatgctcattgagggtaggttttgtagctccttctgacactttacatgaagtgccttgtcagcacatntgtagccttgaccacagcttaaatgtttgnatactcctttttattagggcagcttcattttgtttacacactgttttcatttctccagggaacaatttcaaaatgatcttccagatgctatataactaanaacttttaaactactgacctcaaaggtcancctgtttactggcatctgactgtgtagaacaggaagtttgtgntgcatcttgtgttcttaatgaaatccgacaacagaggactgaacgcattantctcagaacaggagg

SEQ ID NO: 8949 - DNA, 564 bp, Homo sapiens
cctctcagaaaactgagcatactagcaagacagctcttcttgaaaaaaaaaatatgtatacacaaatatatacgtatatctatatatacgtatgtatatacacacatgtatattcttccttgattgtgtagctgtccaaaataataacatatatagagggagctgtattcctttatacaaatctgatggctcctgcagcactttttccttctgaaaatatttacattttgctaacctagtttgttactttaaaaatcagttttgatgaaaggagggaaaagcagatggacttgaaaaagatccaagctcctattagaaaaggtatgaaaatctttatagtaaaattttttataaactaaagttgtaccttttaatatgtagtaaactctcatttatttggggttcgctcttggatctcatccatccattgtgttctctttaatgctgcctgccttttgaggcattcactgccctagacaatgccaccagagatagtgggggaaatgccagatgaaaccaactcttgctctcactagttgtcagcttctctggataagtgaccac

SEQ ID NO: 8950 - DNA, 608 bp, Homo sapiens
  misc_feature (1)...(608): n = g, a, c or t
ccaaacatacattaagtttaatttcaatgacagntncaatttncaatttacttttagatggttagttaactcttttcctactaaatgaaaatattcaatatgccacatatgaaaaaaataaaattctcccacccacaaaaaatcctccaggggcacaaaaaaaatcatttgttccctcatttttaaatatttctgcatgatgagacaatataaaggcacaatataggttaaaataaatcactctgtggtttctcaaaaaaagtgaaaacagatccaccatatgatccagcaatcccacttctgggaatacatccaaaagaaaggaaataagtaccttgaagagatatctgtactcccctgtttattgcagcactattcacaatagccaagatatggaagcaataatatttcttcttgaggaataaaatttttaaatgtggtatttatatacaatggaatattattcagccatgaaaaagaataaaactctatcatttgcagcaacatggatggaactggaggatattatgttaagcaaaataagccaggcacagaaagacaaatatcacatatcctctgtcatatgtgggagctaaaaaagttgatct

SEQ ID NO: 8951 - DNA, 479 bp, Homo sapiens
ctgggaacatttcccagtgcaactcacatttttcactgctctgtgcctgtctgtataagctcaatgagtattgatttaggggctttggagaactttgaatgctaccccccaagtaaccattattggcaacctggtacctctacttttagccatttctccttctctataaacagtgcagaagtaacccacttggtaacaggcatccttgccaagcctccaccactaggtcagtgtaagaattaaagaaagaggaaagaaacacgaaaagtggcttgatggttaagacaggtttattttagagaaaacacacctgagaggggctgctggctgaattaggttagagtcttttctacagactaagagtgtttaaggatttagggtgggagagtttcttagaggcttggactgcttctgtgtttttttgttgtgcttatatgggagggagagtggtgtgtttgcttttatacatttttctgcag

SEQ ID NO: 8952 - DNA, 608 bp, Homo sapiens
ctgtggctgtctgtcagagaagcacatttttctgcagataattagaatggcttcccccatctctcacggactgtcccaagtctagaaaagaattgagttcctcttctattagtcaaataaaagggaagagaatgtttgtcttcctttcctttctgtagtgttaagaaaataaacgaacttaatgattctaaattatcagtgagcttaacactgtactatagaccaaagattaccttttcaaaaagtcctttgaggtgaaatattttgtatacgtaatacatagatgcacatataaacacacacatatagaatctcaatattttaacacttctttgggtagttgtactaactcactaaccctgaggaaaaagttaagaaattgaaagtgttttcttcaaaagttgagatttaacaataaaaggtgttactttgataactaaaaggaactttattatcctcttcctaaaataaaccaatgcctattctgaaaatggcacttgcaattacaatttgccattatcaaagctaccactgaggtagaggcattatctaaaacaaataccacttatcatttattggcagttacctcgagagagacccatacacca

SEQ ID NO: 8953 - DNA, 68 bp, Homo sapiens
  misc_feature (1)...(68): n = g, a, c or t
tacttttatatttccatacaatcagaancagtnaaaaaaatttgganagnanataaaaacntnttaaa

SEQ ID NO: 8954 - DNA, 547 bp, Homo sapiens
gcccggccatcttatttattttaaaaatgtatgtatttatagatttaggaggtataagtgcagattccttacacgcatgtatcacatagtggtgaagtctgggcttttagtgtacctgtcacccaaatagtggacattgtattcaactggtaatttttcaatcctcagccaactccaacccagaaaagcactttgaaaaaatgactttggctgcagtgtagtttggaagtagcccatgctagatacaaggagcctagcaaaatattatcacagtaattcaaaggatagataatggtaggttagactagggtggtgactgtgaagatgaagagaaatgaaataaattgatcgataattaagaggtaaagttaggctgcgcatggtggctcacgcctgtaatcccagaactttgggaggctgaggtgggaagattgtccaagagttcaagaccaatctgggcaacatagtgagacctcgtctactaaaactcaaaaaaattagccgggcatagcggcacacgcctataatcccagctacctggggaggc

SEQ ID NO: 8955 - DNA, 602 bp, Homo sapiens
ctgcacatggattggttaacataatatatactgctatataatcttttaagggctaatatttgtagataatttaaaagcatgtcaatttcctctaagatttgattatttaacctgcacaaaggccaatcttcagttatcaatgacaagaaaactctagggctgccaaaataacttcattttagaccccagagttagtgttaggctggtaatgtttctaatttgggaataatgagactagaaagctaggagggccccctccaaatttctcccttgtattaggctgaagtagaacataacgtggcttaaagcataaacttaaagcatatgctttgagttttaaaaatgttaacctgtaattaattattagagtattatccatagtctactatgatagtcagttaatattctctaaatcagattatattcatttgaaaatgcatctgcatatttgcaaatgtgttattacacaagatcttacctatgtcaatttaaagaggttaaagatgcaggaagcccccactaaaatgtaaacacatttgtacggttttcagaatgtttggactcattctttcccattgacagagcagtaggttttaattaga

SEQ ID NO: 8956 - DNA, 381 bp, Homo sapiens
cctgagacctgggaggaagctggagaaaagatgccctctgaatctttgtgtttggctgcccaggctcgccttgacaccgaatggttgaaaacagatatacagatggtagtgtcgaaccaagtggaacaaagaaagaagatctgaatgacaaagagaaaaaaaatgaagacgaaactcctgcacctgtatatagggccaagtcaattctggagacctgggtgtgggtcaagcaaccaggtaatctgagttttggcactttggaaagcttgatctgacgctccttttctaaataacttggatggattattcgtattttttggtaacaattttaaaaaatgtaattaaaaaaatttaaatatcgtggtaaaatatacataccaa

SEQ ID NO: 8957 - DNA, 535 bp, Homo sapiens
  misc_feature (1)...(535): n = g, a, c or t
ccagaaaggaaactgacgagcaggtcacatgatcaggagccagactcctgagttgtaactgggcccccaactttccgtgtgattattaaaagagcccttcttcttttctaaaacttagtgccaaatgctgaggagcataatgtaggtgagaattttttttttggggggggtgaaaattaagctagagcttcttgaagtacctagtttccaggggctttntattgtatttttccttatggtcctagaatgacatcaacttggaaatgaagcttttgctganaaagctggaggtgatagtggtggtgattttgggagtggagtggacgtgataatgggaccctttaagtcatctatttcccaaggtgtntatcaaatgagagcagncctaacaatatataatctgttggggttgtaactatggtangacataataacatcggcaaaatgatttaattttctgcagcaggattgaaggttgcacgcagttaaaaattatgttaaatttatttacattaatgcaaaattgncatagacc

SEQ ID NO: 8958 - DNA, 607 bp, Homo sapiens
  misc_feature (1)...(607): n = g, a, c or t
ccatcggngctgaaattgagcattttaaatagtacagtaggctggtatacattaggaaatggactgcactggaggcaaatagaaaactaaagaaattagataggctggaaatgcttactttctgctctcattttctttcattttgtctgctgtctttttgaatgccaatactttcatttaaaatgttttgggagcacggcaacccaaaatgactgaacggtggtccaaaaatccaaaccaactgataattacttctcgaggtgataggaaaggcacaggaagttaggactttggctgaaatgatgaaaacacatgttcgccattttagggatcagcgcctcgactcctgccacctccggctccaacgatgatcatgtttggatgtatttattgaattgtcctttgctgatgaggaatttttaaagtatttcatagaataagtcctttggtatgcagatgctacatggaaggaaagaaagaaaaaaagaaaacacacaatattacttgctccataccctaaactgccgataccacagccgtaaaatgaaggtgtctagtagttgttatagcacggtagtccattctttctaaaggaccacttacggtt

SEQ ID NO: 8959 - DNA, 570 bp, Homo sapiens
  misc_feature (1)...(570): n = g, a, c or t
caatatttctaaatcatattttgatgacaacttacaggatcagtgattgagacaatgactagtgtatcaaacgctatctgatagttttcttagcatattccgtgtgtggnggtacatttattgtggtgtgcaaaatctgacaactgacgatttttctctgtcagcaaaactaacaaatttttaaaaatgattttaatagttataactaaaataagcttagacttccaagtcagtcaaatgcccaaactgcatgttttctgccgttccccaaatncttttacatgttttaaatagcctttagaatatgatcgatcacatggctgtatttcagatctaaaagttttgagattttcaaaatcaaaaattactttnttatgcaaaatggcaatgcaaacagcaatcctacataatgtagaataatttttcttctgtacggctccttctaaaaaatgggtaaccacacacacacacacacacacacacgacataaatttagtccatctgaagaagcactccagctttctaattccacttttgaaggaaaaggcagaggcatgtttacattatccc

SEQ ID NO: 8960 - DNA, 86 bp, Homo sapiens
ggaatcatataatataggtactttgtccctgattaaataatgtgacggatagaatgcatcaagtgtttattatgaaaagagtggaa

SEQ ID NO: 8961 - DNA, 458 bp, Homo sapiens
tcgacacgatgacacacaataatttttggttgaagaagatagaaatcagtgtttcagaagcagaaaaacgaactggaagaaatgccatgaacatgcaagaaacatatactgcttacctcattgaaacaaggtcagttgaacataccgatggtcagagtgtcctaacagactcactatggcggcgatatagtgaatttgagttgttgagaagctaccttttagtttactatccacatattgttgtgccacctctgccagaaaaacgggcagaatttgtttggcataaactctctgctgacaacatggatccagattttgtggagaggcgacggattggtttagaaaactttctcttgaggattgcttcacatcccatcctttgtagagacaaaatcttctatctgtttttaacacaggaaggtaactggaaggagactgtgaatgaaactgggtttcag

SEQ ID NO: 8962 - DNA, 603 bp, Homo sapiens
  misc_feature (1)...(603): n = g, a, c or t
ccactgtgtagcaccttctaattcaatttcatcggcagttgtaataacagttccagcctcaggtgttttaatggtgggaaacatcttgattgcttctccagaaacttgaccatcggttttgttttggaaatcttggagaatctcagttccttccacagcaataagttctgtgggagaagcttccatttcttctaataactcaggtttaccatcatcttctgaaggttctaattttgtgtcaggagataaagagggaggctcagttatgtgaaggtattcctcacttgatggtttgaaagtcgcttcaatatttacatgaatttccttaaaagaatcctgtggggacattacagatgagccgacgtctattcctggcagagcactgggctgggggatctctgtgtgtccagaggcttcactgcctgagtagatagtgaggggagatgatggtgtctgagaagacaacttcgcaaatgttgaaactgctaatgttgtatcagtgtaatatgggggattggatccttccatnacatcaggcacctctgttacactctgatccataaggngggtagtagcaatacttanatagggagtatggtctac

SEQ ID NO: 8963 - DNA, 596 bp, Homo sapiens
gttgtagggttgccagatgcaatacaagattcctggttaaatttgaatttcagtaaacaatgaatagtttttcattgtaccatgaaatatccagaacatacttatatgtaaagtattatttatttgaatctacaaaaaacaacaaataatttttaaatataaggattttcctagatattgcacgggagaatatacaaatagcaaaattgaggccaagggccaagagaatatccgaactttaatttcaggaattgaatgggtttgctagaatgtgatatttgaagcatcacataaaaatgatgggacaataaattttgccataaagtcaaatttagctggaaatcctggatttttttctgttaaatctggcaaccctagtctgctagccaggatccacaagtccttgttccactgtgccttggtttctcctttatttctaagtggaaaaagtattagccaccatcttacctcacagtgatgttgtgaggacatgtggaagcactttaagttttttcatcataacataaattattttcaagtgtaacttattaacctatttattatttatgtatttatttaagcatcaaatatttgtg

SEQ ID NO: 8964 - DNA, 606 bp, Homo sapiens
ctgaaggtttttttattctttctttttttaaagtgagcccatgatttggtgtctttcccagattatcccctttgcgacaacacaagcaaaaatatttacaaaggtaaggcatagtcaaactacataaagagaaaaaatcatgaggaaaatacatgaaaaagactaaagacttcgccataacaaggtcttagtgataatagtgtccgtaaagatgtcatcagaattggtaaagtcaagcatgctgcaaatataccctttggattagaaaagagcacaattttctttttttgttttgttctgttttaagaagtggcatactgctctttctccctttggataatttcttttaagcccatcaaaggaaaaaacaaacacaattcaaacaaacactgtcaagtgattcaagatcaaatatttacaataatcaaatggagtatcagattttttttttccaaactgataccacaaatacagagctgaaatctctctttggctcctctatatgcaaaattgaattagtcttcattgaagacaattatatagtcagttccagatgcaaaaggaaacagccttacaaggccctaaagaacacatgctcctacccta

SEQ ID NO: 8965 - DNA, 243 bp, Homo sapiens
agccaatcttcattgctcaagtgtctgaagcagccatggcagaagtacctgagctcgccagtgaaatgatggcttattacagtggcaatgaggatgacttgttctttgaagctgatggccctaaacagatgaagtgctccttccaggacctggacctctgccctctggatggcggcatccagctacgaatctccgaccaccactacagcaagggcttcaggcaggccgcgtcagttgttgtgg

SEQ ID NO: 8966 - DNA, 520 bp, Homo sapiens
  misc_feature (1)...(520): n = g, a, c or t
cctggtgcaaatcaacaaaagtaatgggaaggagacagtggtagggagactcaacgagactcacatcttcaacggaagtaattggatcatgctgatctataaagggggtgatgaatatgacaaccactgtggcaaggagcagcgtcgtgcagtggtgatgatctcctgcaatcgacacaccctagcggacaattttaaccctgtgtctgaggagcgtggcaaagtccaagattgtttctacctctttgagatggatagcagcctggcctgttcaccagagatctcccacctcagtgtgggttccatcttacttgtcacgtttgcatcactggttgctgtttatgttgttggggggttcctataccagcgactggtagtgggagccaaaggaatggagcagtttccccacttagccttctggcaggatcttggcaacctggtagcagatggctgtgactttgtctgccgntctaaacctcgaaatgtgcctgcagcatatcgtggtgtgggggatgaccag

SEQ ID NO: 8967 - DNA, 596 bp, Homo sapiens
  misc_feature (1)...(596): n = g, a, c or t
caaaacgcagcantatgactgcaaatggtacattccgctcacggatntnagcttccanatggnggatgaactggaggcagngcccaacatccccctggtgcccgatgaggagctggacgctttgaagatcaagatctcccagatcaagaatgacntccagagagagaagagggcgaacaagggcagcaaggctacngagaggctgaagaanaagctgtcggagcaggagtcactgctgctgcttatgtctcccagcatggccttcanggtgcacagccgcnncggcaagagttacacgttcctgatctcctctgactatgagcgtgcagagnggagggagaacatccgggagcagcagaagaagtgtttcanaagcttctccctgacatccgtggagctgcagatgctgaccaactcgtgtgtgaaactccagactgtccacagcattccgctgaccatcaataaggaagatgatgagtctccggggctctatgggtttctgaatgtcatcgtccactcnnccactggatttaagcagagttcaaatctgnactgcaccctggaggtggattcctttgngtattnngtgaataaag

SEQ ID NO: 8968 - DNA, 601 bp, Homo sapiens
  misc_feature (1)...(601): n = g, a, c or t
caccatattggccaggttggtctcgaactcaccatattggcctcaggtgatccgcccgcctcngcctcccaaagtgttgggattatgggcgtgagccagccacggtgcccggcctgttttattgtttgaaaaacaagtacaggttgttattatccaagaattgttgatagagtatatactgtatttgaagtgtanaactgaggcagaggctgattaatataactagtttacatttgttagnctttcacatctgtgaaggaataaagtacagacaaaagtggaaaacaaaccaggaaaaacaaattgtgaagcacagagctgcttaaaagaaaaaagtcacagaaataagtcagtattttgtttagagactagaactccaactgctagccaactgcctagaatatagtaaatattttctagtttcttaaatgactagtaatattcctacattatgtgatggcatttcccaaactgtttaattagatgttagatttgtagccaaatatgtctaggaaatgcttaaacaatataaaacagttttaatgattggctttttagaacgttatatattagtgtgctttatgcatatccaagaggngag

SEQ ID NO: 8969 - DNA, 457 bp, Homo sapiens
ggtgggcgcgccttaatgataaggagggatatgttccacgtaacttgctgggactgtacccaagaattaaaccaagacaaaggagcttggcctgaaacttccgcacagaattttagtcaatgaagaattaatctctgttaagaagaagtaatacgattatttttggcaaaaatttcacaagacttattttaatgacaatgtagcttgaaagcgatgaagaatgtctctagaagagaatgaaggattgaagaattcaccattagaggacatttagcgtgatgaaataaagcatctacgtcagcaggccatactgtgttggggcaaaggtgtcccgtgtagcactcagataagtatacagcgacaatcctgttttctacaagaatcctgtctagtaaataggatcatttattgggcagttgggaaatcagctctctgtcctgttgagtgttttcagcag

SEQ ID NO: 8970 - DNA, 485 bp, Homo sapiens
ctgcctttgctaaaagtgctgccatgttaggtaattctgaggatcatactgctttatctagagctttgtctcagcttgcagaggttgaggagaagatagaccagttacatcaagaacaagcttttgctgacttttatatgttttcagaactacttagtgactacattcgtcttattgctgcagtgaaaggtgtgtttgaccatcgaatgaagtgctggcagaaatgggaagatgctcaaattactttgctcaaaaaacgtgaagctgaagcaaaaatgatggttgctaacaaaccagataaaatacagcaagctaaaaatgaaataagagagtgggaggcgaaagtgcaacaaggggaaagagattttgaacagatatctaaaacgattcgaaaagaagtgggaagatttgagaaagaacgagtgaaggattttaaaaccgttatcatcaagtacttagaatcactagttcaaacacaacaacag

SEQ ID NO: 8971 - DNA, 380 bp, Homo sapiens
ccaaggctttatattgttgctgtgtaacaacttacctcaatacttaagagcagttcagagaaacaaaccagcatctatgggtcagcaattgggagcaacttaactgattctgggtaaagctcaaggttccaatcacagaaaactaggattggagaatttttttaatatccagagtggcatactaacagctttaaagttaatcctggttgtcatcttccctcggtgagtgatttgagcaagaaaagctgtaaattgaacacgctctacgaagtagtcgtgctatcttgcatcctttatggtcacagaatgtggtgggagggttcttttccctggtacaattaccaagcaggcagggagcattgggaactctcagatgccag

SEQ ID NO: 8972 - DNA, 297 bp, Homo sapiens
ccactgaactgcgctgccagtgtttgcagaccctgcagggaattcaccccaagaacatccaaagcgtgaacgtgaagtcccccggaccccactgcgcccaaaccgaagtcatagccacactcaagaatgggcggaaagcttgcctcaatcctgcatcccccatagttaagaaaatcatcgaaaagatgctgaacagtgacaaatccaactgaccagaagggaggaggaagctcactggtggctgttcctgaaggaggccctgcccttataggaacagaagaggaaagagagacacag

SEQ ID NO: 8973 - DNA, 478 bp, Homo sapiens
  misc_feature (1)...(478): n = g, a, c or t
ctgaaccctcgtggagccattcatacaggtccctatttaaggaacaagtgattatgctacctttgcacggttagggtaccgcggccgttaaacatgtgtcactgggcaggcggtgcctctaatactggtgatgctagaggtgatgtttttggtaaacaggcggggtaagatttgccgagttccttttactttttttaacctttccttatgagcatgcctgtgttgggttgacagtgagggtaataatgacttgttggttgattgtagatattgggctgttaattgtcagttcagtgttttaatctgacgcangcttatgcggaggagaatgttttcatgttacttatactaacattagttcttctatagggtgatagattggtccaattgggtgtgaggagttcagttatatgtttgggattttttaggtagtgggtgttgagcttgaacgctttcttaattggtggctgcttttagg

SEQ ID NO: 8974 - DNA, 366 bp, Homo sapiens
ccttctcccctcctccagagagggggcaggtgaggggctatcaggaacacgctccttaataactgatgtctcaactctggatgggggactctgaacttgtgctgctgctgccatatttgcaatggtgctgaggtggttcatctggctcattgccatggtgacagatgctggaggtaggctgacaggaattagggggtggggcatcatcataaaaggaagttccagtccgacacttgaattcatgtccccgttttcagagtctgctccatgttggttattactggcatgatagttgctcatggcttctaatttgattttttttcaccttcattgcttcagcaatagctgcattggtagcagcagcag

SEQ ID NO: 8975 - DNA, 406 bp, Homo sapiens
tttttatttagcgatgttttatttagctgaaatgttatttcacttgtaaaaactatctccggttacaaaaaaaaatcagaaaccttattaaatttaacctgcttttacaaatgtcctaagaagtcttaagctaaacaaaatttaagtaggaaaacgataatttaaaaatagtgtgttatactatttctgtggtttatgtacatatattaactggtctcttggataggaaacatgactagaagtttatcacactaagcactgtaaaataaaggcaagagctaatcatcttctagaaaaatagtctctatgcaacaattgcaaatgtcaaagctattatttagtagttaattgcctgctacaatacataaaacaaagtacatttactggattgtttttcagtttgcag

SEQ ID NO: 8976 - DNA, 559 bp, Homo sapiens
ccaaaagattgacagtcctgggttgtccagcctggagattgcctttgtggaattgccagaattggtattgctgtatttgggattctgaatcttggcataacagttttggcactttctccacctgagcttgctgtccttcggcttgaacattttggaattgtcctttcggggatttcttctcttgggccggctggtcttcagtttgctgatcctgggtttgcttctttgagttttgctccttatcagtctgctggtctttaacttgtctatctttagattgtccttctgggtattgttcccctttggcttgctgatcttcagcttgctgatctgggagttgctctttagtttgattaagttgagcttgcttatctacggagtgcctctttggggatagccagtctttgatttgctggtctaaggatttctgctttggagattgccagcctttgctttgctgatctaaggaatgcctctttgaggatttctggcctttggcttgcacgtctaaagaatgtctccttaagtattgcaaggctttggtttgctggtttaagga

SEQ ID NO: 8977 - DNA, 502 bp, Homo sapiens
ccaagaagcaacagagatataaagctgaatcttgtagctaacccctgaaagcaagccaacgcaaattcctccgccaggccagtcttctagtgccaatatggagactgtgggccacagaagattcccttctatttcaggttctcaaaaagtggtgtagactcaggcaaatgccaggaaatgtgtccatatgccagaggagacacagagccagaaatgaaggctatgggtcctgtcttcagtgaaacactgaacgctctcggaaagctcccatcattcttgcatcgctactgccaccaagacggtggcaagggaggaggctaactttcaaatgcatgcaacggcaggtaatatactgtggaagctggaggtttacttttcatgttttagttactttcttgcaaacagcagtccaggaaagcaagcaagcaggtaaaactccgggtgtgcatgaggagatgatccaaggccagtgggcctcccagtgagaaccaaacaggagtgg

SEQ ID NO: 8978 - DNA, 556 bp, Homo sapiens
  misc_feature (1)...(556): n = g, a, c or t
cctaacccctgggagggtaaatgtgggtttctagaatactaagtaaatttgactaacaatgccaaaatgccccctgcctgttttgggacgtttacctcagtccctaatgggcttcagacctgaaaaatgcaatgtctggtttgggcactttgggcctgtaagccttcttggtgaagagcagaaactttgcagtaacaccttcagtgagttcaaggctaggatccctgtcaacattatttaatctctttgagctttagcaaaatagggtagataatggtagttatttcatagggttgtgtgcagcttaagggagatcatgaatggacatttctaacccaatgtgacaatcagtgaccaatatgttttggctttttcaaaccaagaatctagttgagtccacagccacttctttcttgaaaaaaaaaaaaaaaagcattcaggagtgcaagttttctgctatagaaggcagtgggtacagacagaccttccctgagtggagggctggganagagtctgcatggggacatccctccaagcaacttcagagtgacagaag

SEQ ID NO: 8979 - DNA, 360 bp, Homo sapiens
ctgtctcttacttttaaccagtgaaattgacctgcccgtgaagaggcgggcataacacagcaagacgagaagaccctatggagctttaatttattaatgcaaacagtacctaacaaacccacaggtcctaaactaccaaacctgcattaaaaatttcggttggggcgacctcggagcagaacccaacctccgagcagtacatgctaagacttcaccagtcaaagcgaactactatactcaattgatccaataacttgaccaacggaacaagttaccctagggataacagcgcaatcctattctagagtccatatcaacaatagggtttacgacctcgatgttggatcaggacatcccaat

SEQ ID NO: 8980 - DNA, 224 bp, Homo sapiens
ctggtgttaatggcatgcaggcatatgtgatgccaaccatgagggctggaagaaccagaagccaaagaagaatatgaccgcatctattctaaagctactgtggtggtttctcatgcttcagagtctcgtaagtctcctggttcctggtgctcaggcccgtgtaaacaccatctgatttctcatagctggttatagctgcctttcgcacttggatcttcagtcga

SEQ ID NO: 8981 - DNA, 593 bp, Homo sapiens
ctggtttcagtgaaactgccaaaatcctcaagccaggaagtagaagccaaggagctgtcctttgttttggattacataaaccagtcacccaagtgcattgcctttggaaacgagggagtatatgttgctgcagtacgggaattttacttgtctgtttattttttcaaaaagaaaacaacatcaaggtttactttatcatcatcaagaaataagaagcatgctaaaaacaattttacgtgtgtagcatgtcacccaacggaagactgcatcgcatctggtcacatggatggcaaaattcgtctttggaggaatttttatgatgataagaaatatacgtacacatgtttacattggcaccatgatatggttatggatttggctttttcagtgacaggcaccagtctgctgagtggcggtcgtgaatctgtacttgtagagtggcgcgatgcaacagagaagaataaggagtttctcccgcgtttaggagctactattgaacatatctcagtctcgcctgcaggagatttattctgcacttctcactctgataataagataataattattcaccgaaaccttgaagcatccgcagt

SEQ ID NO: 8982 - DNA, 591 bp, Homo sapiens
ccatatccttgtctaaaatgtatattgaacaaaatgcatgctcttgaaatgtctcaaaaccttacaccctgggaataattgcatatataacttgtgtttggagaatcacatgaactttaatcagggtaatagcactttcaaacttgctagtagattttactgtaggtgtaatgccttaatcatctttttgaatgttttctcagagctggaggttgctgggcacctaaatgatgtttcatgatagctttgggtgattttactgctatttataatttgctgtataaagtgagcattacttaatttgcaagctgatttctcacagtgtaaatttgttcattcctggtagtctattttctataaaaatgtatttttgcacaacatttttaaaaactggtgtaccttcatctatgacgtgttccattttgacaaacagctttcaggcgtaaatccagagaagtgctttatatgaaatgtattattttgaacagagtttgtgatttggtagttattttatgttgttgaaatttgaatttcacaattcttagataattatttcaaatggatattgatgcattcttgttaccagatgtt

SEQ ID NO: 8983 - DNA, 582 bp, Homo sapiens
cctagtagtggggtgaggcttggattagcgtttagaagggctatttgttgtgggtctcatgagttggagtgtaggataaatcatgctaaggcgaggatgaaaccgatatcgccgatacggttgtataggattgcttgaatggctgctgtgttggcatctgctcgggcgtatcatcaactgatgagcaagaaggatataattcctacgccctctcagccgatgaacagttggaataggttgttagcggtaactaagattagtatggtaattaggaagatgagtagatatttgaagaactgattaatgtttgggtctgagtttatatatcacagtgagaattctatgatggaccatgtaacgaacaatgctacagggatgaatattatggagaagtagtctagtttgaagcttagggagagctgggttgtttggattgtggctcagtgtcagttcgagataataacttcttggtctaggcacatgaatattgttgtggggaagagactgataataaaggtggatgcgacaatggattttacataatgggggtatgagttttttttgttagggttaacgagggtg

SEQ ID NO: 8984 - DNA, 549 bp, Homo sapiens
  misc_feature (1)...(549): n = g, a, c or t
ccagttttcttccttggagtagcaatctgtaaaaataagtgctgctgtttaaaaagtagcatgccctacaccataccaatgtattagtgagaatttggcgattctcaccaaacaacaatgaagtttcacatttggtactggatggagcttgggttagatctgccttttaaggcaaagtcaactctttcaacttaattctttttcaagggagtaatgtactgtctacacttggcttaaactaacttctattatggactactttcaatgtacatgtaaatattcatgcatcagaagccaatttcttttaacagtacatagaaaaggtatattttggggtgctaatgaacacttcaaattaagtaatgatattggtaaggatcaaactgcactattagtcttgttaataccacactggcacacacactgcatatatatgtattttcctaagataaaactcttctcagaatttcattactttttattatacaccaactagtttatattgnagttctttacaaagaaaatgctaagaaaaattataatcacatg

SEQ ID NO: 8985 - DNA, 270 bp, Homo sapiens
ctggtgtttatccgtcactcgccgaggttccttgggtcatggtgccagcctgactgagaagaggacgctcccgggagacgaatgaggaaccacctcctcctactgttcaagtacaggggcctggtccgcaaagggaagaaaagcaaaagacgaaaatggctaaattcgtgatccgcccagccactgccgccgactgcagtgacatactgcggctgatcaaggagctggctaaatatgaatacatggaagaacaagtaatcttaactgaaa

SEQ ID NO: 8986 - DNA, 507 bp, Homo sapiens
  misc_feature (1)...(507): n = g, a, c or t
attgacngtcctgggttgtccagccnggagattgcctttgnggaattgccagaattggtattgntgtatttgggattntgaatcttggcntaacagttntggcactttctncacctgagcttgctgtccttcggcttgaacattttggaattgtcctttcngggatttcttntcttgggccggctggtcttnagtttgctgatcctgggtntgcttntttnagttttgctccttatcagtctgctggtctttaacttgtctatctttagattgtccttctgggtattgttcccctttggcttgctgatcttcagcttgctgatctgggagttgctctttagttngattaantngagcttgcttatctacggagtgcctctttggggatagccnntntttgatttgctggtctaanngatttctgctttggagatngccancctttgctttgctgatctaaggnatgcctctttgangatttntggcctttggcttncacgtcnaaag

SEQ ID NO: 8987 - DNA, 364 bp, Homo sapiens
  misc_feature (1)...(364): n = g, a, c or t
cctattctgaactgcanatgctgtcccccagcgagcggcagtgtgtggagacggtggtcaacatgggctactcgtacgagtgtgtcctcagagccatgaagaagaaaggagagaatattgagcagattctcgactatctctttgcacatggacagctttgngagaagggcttcgaccctcttttngtgnaagaggctctgganatgcaccagngttcanaagaaaagatgatggagtttcttcagttaatgagcaaatttaaggagatgggctttgagctgaaagacattaaggaagttttgctattacacaacaatgaccagnacaatgctttggaagacctcatggctcgggcaggagccag

SEQ ID NO: 8988 - DNA, 325 bp, Homo sapiens
  misc_feature (1)...(325): n = g, a, c or t
atcacattctcgatccagaggaangcgatactctcgctcacgcancaggagcaggggacgaaggtcaaggtcagcatctcctcgacgatcaagatctatctctcttcgtagatcaagatcagcttcactcagaagatctangtctggntctataaaaggatcnaggtatttccaatncccgtcgaggtcaagatcaagatccaggtctatttcacgaccaagaagcagccgatcaaagtccagatctccatctccaaaaagaagtcgttccccatcaggaagtcctcgcagaagtgcaagtcctgaaagaatggactgaagctct

SEQ ID NO: 8989 - DNA, 426 bp, Homo sapiens
ccagtcaacatctacagactagaagggagaaaagaagtcattaaaacagatattactgttgtggtaagcatttgctggtaatgctgtataaatttaatagttttaatatagtgcaacagaagaaactgcatttgaagaaaagagctattgaataccataaattaaccctcaagtctgttctaggtattcttgggcctgaggtcttctgaattaattgagtagcagtatttggctactcagttggttattaactgtgctttttgactgataagagaatacatttaaattttttaaatggtatttatggggccaggtgtggtggctcacacctttaatcccagcactttgggaggccgatcaattatatagatcaacatgatcaaggtgggcagaccactcaaagtcaagagttcaagaccagcctgg

SEQ ID NO: 8990 - DNA, 494 bp, Homo sapiens
ccttatttctcttgtcctttcgtacagggaggaatttgaagtagatagaaaccgacctggattactccggtctgaactcagatcacgtaggactttaatcgttgaacaaacgaacctttaatagcggctgcaccatcgggatgtcctgatccaacatcgaggtcgtaaaccctattgttgatatggactctagaataggattgcgctgttatccctagggtaacttgttccgttggtcaagttattggatcaattgagtatagtagttcgctttgactggtgaagtcttagcatgtactgctcggaggttgggttctgctccgaggtcgccccaaccgaaatttttaatgcaggtttggtagtttaggacctgtgggtttgttaggtactgtttgcattaataaattaaagctccatagggtcttctcgtcttgctgtgttatgcccgcctcttcacgggcaggtcaatttcactggttaaaagtaagagacag

SEQ ID NO: 8991 - DNA, 376 bp, Homo sapiens
ccatcaactggaactatgtcattatttataaaacaggagcaatcacagggctgtggtgagaatcacatgaggtgacacatgtgaaatggtcctttcccctaagacatatataattgtgacaaggaacaaaatttacatagaaaataattacagaacaacgtaggaccatgtcttcatttctccctggagcggatgtaaaataaggtgattgatttgagcaagcatgttatgaatatttagaaatgtcttctagggaagcaagctggcgctcaccgattttggtttgccaggcatatcagaaggcactttgtgacaggtgcagtagggacgcggagtgatctcttcacgtgtaggcaatgcccagcccacacctagg

SEQ ID NO: 8992 - DNA, 173 bp, Homo sapiens
ccatgggggacgtgctgtccacgcacctggacgacgcccggcgccagcacatcgcagaaaaaaccgggaagatcctgacggagttcctccagttctatgaagaccagtatggcgtggctctcttcaacagcatgcgccatgagattgagggcacggggctgccgcaggcccag

SEQ ID NO: 8993 - DNA, 599 bp, Homo sapiens
cctaagtaaatgaagagctgtaccatattcatgtattggaagacaacattgtaaagatgacatggtttaccagattaatctataaattcaatacaaatccaatcaaaatttcaatgctcttgggtttgtttgatttataaattgttggtctaattctagaagtaatatggaggaacagttggctaagaatagccaagacactccaaggaagaacaattttgtggtgatactggagacagaggtgaaattggttacaattatgacaaaatgtggaggcatcttggtttttatcagaccttttcctaaagttgcaataatcaggactgtactgtactgctacaagattagacaaattgatgtcagtcagaatagaaaccatcaaaagacccacacacatacacaaaaatttaatttatgaaagaggcagtgttacaaatcactggggaaaggatgaacttttcagtaaatagtgcagagacaaccacttcgaatatgaaaaatgttaagttgaatttctaactcataattttcacaaaaatcagttcaggacagactaaagacaaatgtgaaaggcaaaactataaaatttccacaaggca

SEQ ID NO: 8994 - DNA, 597 bp, Homo sapiens
  misc_feature (1)...(597): n = g, a, c or t
ccaagaacctcttccaccgggccatttctgagagtggcgtggccctcacttctgttctggtgaagaaaggtgatgtcaagcccttggctgagcaaatttctatcactgctgggtgcaaaaccaccacctctgctgtcatggttcactgcctgcgacagaagacggaagaggagctcttggagacgacattgaaaatgaaattcttatctctggacttacagggagaccccagagagagtcaaccccttctgggcactgtgattgatgggatgctgctgctgaaaacacctgaagagcttcaagctgaaaggaatttccacactgtcccctacatggtcggaattaacaagcaggagtttggctggttgattccaatgcagttgatgagctatccactctccgaagggcaactggaccagaagacagccatgtcactcctgtggaagtcctatccccttgtttgcattgctaaggaactgattccagaagccactgagaaatacttaggaggaacagacgacactgtcaaaaagaaagacctgttcctggacttgatagcagatgtgatgtttggtgtcccatctgtgattgnggccc

SEQ ID NO: 8995 - DNA, 568 bp, Homo sapiens
cctggtcatagaagtgtaaacaatgtaaatgaatccaccattaccagttgtcatatcatatctatgtcacctgtgtattctgagattacacacatacctgccaatatacctgggaaaggttattttatcacagttacacttgagttcttggcaggcaggactgaggaagagtaatttgaaagaagttttacatcctatttagaagaaatcactagtatttccttaaataacaggttacaatagaaagatactgcctggaagttatcctttcactttggttcatttttagtttttctttatgatttacatagctgtttaattcatttgcttatagtacaatcctgccataaagtattaaagcacaagatacctattattccttcaacatctgcatttttcaagttttatactctacatccacagtacgtcagcagttcttgaatgtttaaaaaaataaatgggtaaaatgcttctaaaaaatgcagatgtttataactacaatggtactaagatgggaaggagacaatgagagaagggataaaagcaaacatgttcatgtgcagggaat

SEQ ID NO: 8996 - DNA, 436 bp, Homo sapiens
ctgagaatcctgggggagaaagaggccaagctggcccagcagagccaggccctacaggagctcatctcagagctagatcgaaggtgccacagctcagcactggaactgctgcaggaggtgataattgtcctggaaaggagtgagtcctggaacctgaaggacctggatattacctctccagaactcaggagtgtgtgccatgtgccagggctgaagaagatgctgaggacatgtgcagtccacatcactctggatccagacacagccaatccgtggctgatactttcagaagatcggagacaagtgaggcttggagacacccagcagagcatacctggaaatgaagagagatttgatagttatcctatggtcctgggtgcccagcactttcactctggaaaacattactgggaggtagatgtgacaggaaaggagg

SEQ ID NO: 8997 - DNA, 599 bp, Homo sapiens
  misc_feature (1)...(599): n = g, a, c or t
cctttctcaatttacagagttgaagaggaaaggcaaatggaggaataaacttcattgtcattgggattaatttggctagactcaatctcttgagccttaaaatgagaaagtaatatccattacatgtttagagttctcaaatagttgatactattattaaatgtttcaaattttattggggtagatactaaaaattagtacactgtcctaatgaagtttaaatgaacaagttttacatttcttaggattcaggaatatatggaatctagttgtatttaattgacttgagagccacagagattgtgttgatttatgagctggactcctattgttttagaaacatgcagtaatgattaacttgtgtcaatgatggtaatgagaccaaacttgtacatttaattaagggtaccagttctttttatgttactagactataccttggcctttaaaaatgaatctcactgattaaagagaacaggcattattaggatagcattccaccacaactagaaacattcaaataatgtgtcttaattgnaatctgtatataggaaaatttttcctatggatatttttggtgttttaccacagtgaactga

SEQ ID NO: 8998 - DNA, 411 bp, Homo sapiens
ctgtcctcacgggcccctggagaaaccgcaggtacacagatgaaggcatggacaggagaagaggggacccggggttgagaataagatagaaggcaaagagaactggggagcagaggagagaggagaaaaatgacacctccggtattgactgctcagtggtacctactggcgctaagcacagtaaaaacacaaaggctactttccaaaaggaaaacaacatcatttaaaaagaaaaagaaaaaaaaccaaaacagccctattcgcccatgagtgtgggaagtgaggaaattatataatacgcctcctccaaggaccccaaacaccctctctgctgtaattaagagaagtgcttactgccagcaccgtcctgccatacctgcttgtgtgactttgaacaagtgtcttatcctc

SEQ ID NO: 8999 - DNA, 381 bp, Homo sapiens
tcgacatttgggggcaagggttccactgaaaaatcccccaaattcacgctgaggtttcaggtcatggttgctgaggtggaagatgaggtcagggctcttggagattttccaacccaccctagaacttgtttctaaatggctggggaagaggtcagtataggtccccccgttactgcagatgaaggcagaagtcattctctcccccacccctcaacttcttcagagatgtggagataggaggcttcgatctctaattgcctacgatctcttaaaaatataaaacacgtgcagttgactttggtacaaaaaagaaaacaaaagaacaacaaaacattctggtccctgtgggttttttccctcacccccaacaaaccattatgg

SEQ ID NO: 9000 - DNA, 372 bp, Homo sapiens
ctgcggttcaagaaaaggtccaaaggaggacccactcgaggtgaggataaatcacaattgtgatcacagaccaggtttctatcttttttattccctttaataaattgggcttgacctgaaactccaagaaagttaatttataacagccaaaataattttttttacgtaacagcccacctttctttttcttttaaacttaaaccattatgacaaatggagatttattacataccataaacacatgtggcttgagcactggtatttagtctggaaactcagatggggcagtaagctgctgctgcaatcaggaaatgccatgtgacattcttgataaagacgaaacacacacacattccacagcacttattgtgg

SEQ ID NO: 9001 - DNA, 375 bp, Homo sapiens
ccatcaactggaactatgtcattatttataaaacaggagcaatcacagggctgtggtgagaatcacatgaggtgacacatgtgaaatggtcctttcccctaagacatatataattgtgacaaggaacaaaatttacatagaaaataattacagaacaacgtaggaccatgtcttcatttctccctggagcggatgtaaaataaggtgattgatttgagcaagcatgttatgaatatttagaaatgtcttctagggaagcaagctggcgctcaccgattttggtttgccaggcatatcagaaggcactttgtgacaggtgcagtagggacgcggagtgatctcttcacgtgtaggcaatgcccagccgacacctag

SEQ ID NO: 9002 - DNA, 596 bp, Homo sapiens
ctgcacatggattggttaacataatatatactgctatataatcttttaagggctaatatttgtagataatttaaaagcatgtcaatttcctctaagatttgattatttaacctgcacaaaggccaatcttcagttatcaatgacaagaaaactctagggctgccaaaataacttcattttagaccccagagttagtgttaggctggtaatgtttctaatttgggaataatgagactagaaagctaggagggccccctccaaatttctcccttgtattaggctgaagtagaacataacgtggcttaaagcataaacttaaagcatatgctttgagttttaaaaatgttaacctgtaattaattattagagtattatccatagtctactatgatagtcagttaatattctctaaatcagattatattcatttgaaaatgcatctgcatatttgcaaatgtgttattacacaagatcttacctatgtcaatttaaagaggttaaagatgcaggaagcccccactaaaatgtaaacacatttgtacggttttcagaatgtttggactcattctttcccattgacagagcagtaggtttta

SEQ ID NO: 9003 - DNA, 599 bp, Homo sapiens
  misc_feature (1)...(599): n = g, a, c or t
cctatgcatagttaataaggttataatctactcaacatggaaaatggagcctatttgcaaacacacaagtaattaaagtaccaattctctcttagtttctttttttatagttggtttattttgcaattataaatgttaaacatccctagagatgaaagttaaaatggttgatcacagatcagtagcaaaatacaaattgacaattcaaaattataaataaaactctgttgaggatgtttaactttgagtctccaaatttaagagctaagcttggaagaaacaaatttataggttatatttccctcttaaattaaaaaacaaacttcctctggcagtagtttgtgaattcctttcattgtaatgataccatgattacaggatcaaaaatgcttaacttacttgccattctgctcacatcatcacagttgtttttttttttttaagcactcaatgtaggcattttaatcttctggataacagagtatcttttgagaaattaaaatcgaattgaccatttgcaatatttggttttcctaataggtactgncttagtaaatgtttaaatccaaacaaatcttctgttcaccggaaaaatacta

SEQ ID NO: 9004 - DNA, 602 bp, Homo sapiens
ctgtagtgcccccccctccactttggtaaacgactcaagttccatgaggactttcacttctttatttataatcacagaagtgaggtgttacttcacacacatacacacacaaagaatgaaataaagaaatgaaactcgctaagcagacaaaaacagacaactttctgcttagaaaacagccttctcggtgggagaggatgaactgccatgtctaagagaaagacttgcccccgaatttgtaggtctgtaactgaccaagttttgtaattattaacaggtatttgccaagtcctaattgctgaatataatgaattggaactagatgcgaaaatagagcaggacctctccccttgatgagtttttattccagccatataattctcaataaaacttttcctgggctggatagcaaaggacacctttggttacctgaatgaacaggtacaggggaaattatttgggggagggaaaaaggagagaaaagcaaggagagagagtgtgagtgtaagagaaagtgaagaagccactcttgagaaaagcttgccataaaggagctaaacccacctgaaattcctacccacggacaccccttctcacttcag

SEQ ID NO: 9005 - DNA, 390 bp, Homo sapiens
aaacagaggcttgcgataggcttttggctcatcgagtggaaaccaaaatgaagggaaataaagtgaatgaggtgctgaatagactgcacctggctatcccaaccaggagggacgataagaagaggccccctttcatccctgaaggagtggtggctcgcaggaagaggatggaaactgaggagtccaggaagaagagggaacgagatcttgagctggaaatgggagatgattatattttggatcttcagaagtactgggatttaatgaatttgtctgaaaaacatgataagataccagaaatctgggaaggccataatatagctgattatattgatccagccatcatgaagaaattggaagaattagaaaaagaagaagagctgagaacag

SEQ ID NO: 9006 - DNA, 589 bp, Homo sapiens
ctgcacgcagccatggctgacacattcctggagcacatgtgccgcctggacattgattcaccacccatcacagcccggaacactggcatcatctgtaccattggcccagcttcccgatcagtggagacgttgaaggagatgattaagtctggaatgaatgtggctcgtctgaacttctctcatggaactcatgagtaccatgcggagaccatcaagaatgtgcgcacagccacggaaagctttgcttctgaccccatcctctaccggcccgttgctgtggctctagacactaaaggacctgagatccgaactgggctcatcaagggcagcggcactgcagaggtggagctgaagaagggagccactctcaaaatcacgctggataacgcctacatggaaaagtgtgacgagaacatcctgtggctggactacaagaacatctgcaaggtggtggaagtgggcagcaagatctacgtggatgatgggcttatttctctccaggtgaagcagaaaggtgccgacttcctggtgacggaggtggaaaatggtggctccttgggcagcaagaagggtgtgaaccttcctgggg

SEQ ID NO: 9007 - DNA, 380 bp, Homo sapiens
caaacatgatcatcgttggagccggaggtggcaggagtcgaggcgctgatccctaaaatggcgaacatgtgttttcatcatttcagccaaagtcctaacttcctgtgcctttcctatcacctcgagaagtaattatcagttggtttggatttttggaccaccgttcagtcattttgggttgccgtgctcccaaaacattttaaatgaaagtattggcattcaaaaagacagcagacaaaatgaaagaaaatgagagcagaaagtaagcatttccagcctatctaatttctttagttttctatttgcctccagtgcagtccatttcctaatgtataccagcctactgtactatttaaaatgctcaatttcagcaccgatgg

SEQ ID NO: 9008 - DNA, 218 bp, Homo sapiens
  misc_feature (1)...(218): n = g, a, c or t
ccatcatcctnttcccctttgggttcatttgctgntttgccttgaggaagcgacgatgccccaactgtggagccaccttcgcttaaagggaacaccaggcccggctttcctacacccagctctntttttctaatgtaaatgttgtgtacaatagttttatttgattaagcttnaggactgttntgnaaagcgaggtgggaccgatgtggcacacgcca

SEQ ID NO: 9009 - DNA, 364 bp, Homo sapiens
  misc_feature (1)...(364): n = g, a, c or t
gtatatcttctttnatgaacatctctttaaaagttttgtaccatttttaaggtcaggttatttatttatcatcagttgtagcagttctttatgtattctggaaccaagtctattggattccaaatacggnattttctttgtatatatggtaaatagaatactttctcttttaagtcataagatatattttaagatattaaatgactaaaattatttaggtcataagttaaatatttttttcctgtggtggtattttttaatcccttctttccacctagtcactttttggaatatctgtagcaataatagtaggaacagtanatgtgcctttggagtgaaaataaatagccatttaaaacatagg

SEQ ID NO: 9010 - DNA, 597 bp, Homo sapiens
ctgggaagccacgagaatattgtgaacctgctgggggcgtgcacactgtcaggaccaatttacttgatttttgaatactgttgctatggtgatcttctcaactatctaagaagtaaaagagaaaaatttcacaggacttggacagagattttcaaggaacacaatttcagtttttaccccactttccaatcacatccaaattccagcatgcctggttcaagagaagttcagatacacccggactcggatcaaatctcagggcttcatgggaattcatttcactctgaagatgaaattgaatatgaaaaccaaaaaaggctggaagaagaggaggacttgaatgtgcttacatttgaagatcttctttgctttgcatatcaagttgccaaaggaatggaatttctggaatttaagtcgtgtgttcacagagacctggccgccaggaacgtgcttgtcacccacgggaaagtggtgaagatatgtgactttggattggctcgatatatcatgagtgattccaactatgttgtcaggggcaatgcccgtctgcctgtaaaatggatggcccccgaaagcctgtttgaaggcatctacacc

SEQ ID NO: 9011 - DNA, 599 bp, Homo sapiens
ccatagaggacgtggaggattcaatatgcgtggtggaaatttcagaggaggaggcaagttaattttgagtgttctgtatttagttcaggatcgaaacaagtgataattttatagtttggatgtagctgaagtttcttcctcattaatggtatactgtcacagtaactaaagtattcatgtgatttgatattaaatacacctaggttatgttaatggttagaattaaacatttcttttgtctttaaacaattatttttggagaaaaaggaacaatctagaggaatcctaagtcttctgtataagtagggtacaatatacaatgaaactaaaacagctcttgtcttttagcccctgggaatcgtggcggatataataggaggggcaacatgccacagagaggtggtggcggtggaggaagtggtggaatcggctatccataccctcgtgcccttgtttttcctggccgtggtagttactcaaacagagggaactacaacagaggtggaatgcccaacagagggaactacaaccagaacttcagaggacgaggaaacaatcgtggctacaaaaatcaatctcagggctacaaccagtggcag

SEQ ID NO: 9012 - DNA, 468 bp, Homo sapiens; identical to SEQ ID NO: 4911

SEQ ID NO: 9013 - DNA, 594 bp, Homo sapiens
ccatctattacactacaaagtagtataatgcaaataaatagaattctatccaggttaaaggttaatagcattagattagcacagtaaggtatgactaagtaattagaacagattttaaaatattttactacattaagaggctggagatatatgtgtgtgtgtgtgtgtgtgtgtgtaattagagatcccatgtcatcagaagcatatatttgacacagccagcctacagtggaatgcagtctcatagaacaataaagctggtcagtctaagtaacatcatgtttgagcagtttaaaacaatgactttcagcgatgaaaccaaaaattcagattttccagtgattcaaagtacttatttcctgcatttaaaaataacttcataaaacttgaaattgatgaagcacaaaccagccttagtttaggtaggggtataacagataaaataacttttaagtgttcatgtgcagatgatttgcttgaccccaccctttgcattttgtgttgaacttagaggtgtcttgctttttttaatatgtcaaataataaagaattaggaaatctgatactttttttttgactcttgctctgtcaccc

SEQ ID NO: 9014 - DNA, 599 bp, Homo sapiens
ctgcaatttgtcctttaaggatgcctcacaaggatattatgtccaggtagctagtccatttatatcggggaccagttgtccttttgttgtttgtggctgtttattaaatgtagtggcacaactttgttgtgaatatgtaccatcatttgctacaatctagacagatcatcctgtctacaaaaaatcattttctacatttctaagaccattatcagtttatctgctcctgctagaaaaggacatactttttgtcaatttacattaacaaaggctctgctactccccatttactcgctgcaatgaaaactggtaagccaagggtaaagcttaagtatcagggactatgaatttagggtagaagtgaaaataaccaaagtggaactaaatcccctattctggagtgcaactgagatcaagtaaacttcgctggactttcttcttaactataaaactattaaccagaaggtaaagtcacacaattttacctcccaacaaacttttaaaataaaaatttccaaaaaatttagatgtctaggttttgttatatcttaccaagagttacacagacataaatttgtatttaacttcagttaaacatc

SEQ ID NO: 9015 - DNA, 562 bp, Homo sapiens
  misc_feature (1)...(562): n = g, a, c or t
cctgtttgattgtagctatgttggtgtatctcgtgtacaagatggaaaagtgcttttgttgttctacctgatccagttgggggagcaggaatagggggtgcctgcctaacggcctctagcccatgtgcttatactgggatctgtcccgagggatctgcacctggttggcagtcattttgtggtggacgtggtaaatcgcgagtgttaccatgatgacgaggcccaagatgagccccaaaatcaggggcaaggtttcttccagttgctcccgctcatccactgggcatttatgctcttcactgaagacaaaatctgagataatgtcaaaaggttggatgtggaccgcagacaggatcatggtgaccgtcttctgcggatcactagaggccagtgaaatggtttgttgagcttgacactcataggacttcccagcgggggtgaccaaggcanagaggtggtgcgagttggctgtgtgcttcccagcactgactgcgtctttgaagtgggttttctccgaggagtcgtagacaaactgcactttgctcagcctccaagtcgcctc

SEQ ID NO: 9016 - DNA, 598 bp, Homo sapiens
tttttttttttttttaaggacaactttttattgctaccagaggcttttatcatcagtacacagttctgactgcaatacctttttcagactgcaaagggaactcaggatccagaagtcattaaaagaaacataaggctggggaggcagggggagtaagttctattagaaaatcctaatagcttaacaaaactagggtactaaattcagttataacatgttacagacttaaatcatagagctgccccaacatctagacagtctctcctactgattataaatgagtgaaaactatcagttagaaaaatctaatttaagttgttaatacatgtttctttggtgagcacctggatatatttatcacaaattcttttatacaaatgtcgaaaatgctttcaacaaacctaagtgtcctaattacatgccacttttaagcatcactttaaggtaaacaaaaatgaaaaccataattttaaattaaaatttgaaatgagacacaaaatcaacctggtaatatgagaactttttcttttgccatctctgattaatatgggacaattccaaagtacccttttcagactaattggaacttgagtcatgg

SEQ ID NO: 9017 - DNA, 528 bp, Homo sapiens
agataaagggttttgaacatgaaatgacaaaaacaacagcaagaagaaaattcttgtcctttttcattactatcagactcaaataaatgtcttggctcttacattacattcattcttcaaccattgtggtctggcttccacttccttcacttcaccaacatggctctgccaaaggaagcccgtgatctctaggccatcactttaattgatctctctacaacatttatcctggttgttaagccctccttacaacattcttctctctttgtttttatagctccatctctcctgcttctttaacttgataatgcatacttgatttttctatttgttatttcataaaccaattaatacacagataaaatgactgtatatcaaaccatgtttgtatagaaaaatggattttggatgcctctcatatgtaattagttctattaaacatattaattgtattgtttaatttgtcaggtttttgacagaattttgtttacaagtaataaaaattttatctccaatttccaaaaaaaa

SEQ ID NO: 9018 - DNA, 469 bp, Homo sapiens
  misc_feature (1)...(469): n = g, a, c or t
ctgcgttncatgtaacaaaagatgcaaacaaaatagattcaagttgttttgcagacagcacaatgatacaatattaggactacagaatctcagagtaaaccacaatgatttaaaggtaagatacacagaaataaaatgattttaacagaaaaatatgacattcctgaccttaggtctgggcacatgatgtctgacccctatagaggcaccttggctaaaatggaaatgacctagtgccatggctgacctcacttgtgcgttgctgagcccatatgtgaacaaatccccttgatacagcaccatggtaggcatgagaggagaagtgttttaactattctcttatgaattgtaaccaacccttattatctactgatggatggacagggggtggggtgatcatacaggatggcagacattccaagtactcttcaccccagtgtggacggaacagaatctggctacacggtgg

SEQ ID NO: 9019 - DNA, 327 bp, Homo sapiens
  misc_feature (1)...(327): n = g, a, c or t
gactacattcntcttattgctgcagtgaaaggngtgnntgaccatcgaatgaagtgctggcagaaatgggaagatgctcaaattactttgctcaaaaaacgtgaagctgaagcaaaaatgatggttgntaacaaaccanataaaatacagcaagctaaaaatgaaataagagagtgggaggcgaaagtgcaacaaggggaaagagattttgaacagatatctaaaacgantcgaaaagaagtgggaagatttgagaaagaacgagtgaangattttaaaaccgttatcatcaagnncttanaatnactagttcaaacacaacaacag

SEQ ID NO: 9020 - DNA, 138 bp, Homo sapiens
ctgcccaaaaggtgtcccatctcttgggtatcaatgtgaccgatttcaccagaggaatcctcaccccgcgcatcaaggtgggacgggattacgtccagaaggcgcagactaaagagcaggctgactttgccatcgagg

SEQ ID NO: 9021 - DNA, 556 bp, Homo sapiens
ccacctgtctgcaagagaggcggcccctgtgcttgcaacgcttacgtgttgatcccagtgtccttttccaaatgagtgctgtagctttagaagtggccctctatagaaagaagtcaaaagatgaggccccttctagaatctaggataacaagagtgttgacagtttgaggagtcgaattgagattcatcatcaaagagcaatgcagcgtcgttaaaataaaaactgtgccttttaaaaagaaaaatgcaaatatagagcaaatccctaaacttgaaccatttcctagtgccttgctagacaaacataaaggggcagggttgtggggaagggaacgtttttggtggtgtgtgcagttcctactggatgagtgtgtgtttcttaatgtctcatttcaagcaggagatgttgggtctggagcaagatctgagactgcgatgtcccccaagggtgacaggtcagatttatttcagtcagtgcaagtcacactccaaactaaaggctgggcagtgcgtttagtctgtggcctagaagacctcatcagcccccgagaggagg

SEQ ID NO: 9022 - DNA, 224 bp, Homo sapiens
ctgaacatctgtttttagcaccatgcctcccttcctccttcaacctcctgatatcactgtcgtctcctctgcaggtgctttggttttgcccttctggtactaagttactgtatcatatgctttctgtttcagattttatggtttaaggtaactgatgagatctacctctgacaaaaagagttggaatttttgtttctatttcctttgttttatgctaagatttt

SEQ ID NO: 9023 - DNA, 569 bp, Homo sapiens
ctgggagagctagactaagttggtcatgatgcagaagctactcaaatgcagtcggcttgtcctggctcttgccctcatcctggttctggaatcctcagttcaaggttatcctacgcagagagccaggtaccaatgggtgcgctgcaatccagacagtaattctgcaaactgccttgaagaaaaaggaccaatgttcgaactacttccaggtgaatccaacaagatcccccgtctgaggactgacctttttccaaagacgagaatccaggacttgaatcgtatcttcccactttctgaggactactctggatcaggcttcggctccggctccggctctggatcaggatctgggagtggcttcctaacggaaatggaacaggattaccaactagtagacgaaagtgatgctttccatgacaaccttaggtctcttgacaggaatctgccctcagacagccaggacttgggtcaacatggattagaagaggattttatgttataaaagaggattttcccaccttgacaccaggcaatgtagttagcatattttatgtaccatggttatatga

SEQ ID NO: 9024 - DNA, 356 bp, Homo sapiens
  misc_feature (1)...(356): n = g, a, c or t
ctgatgaaggcatctgatgccttcatctgttcagtcatctccaaaaacagtaaaaataaccactttttgttgggcaatatgaaatttttaaaggagtagaataccaaatgatagaaacagactgcctgaattgagaattttgattttttaaagtgtgtttctttctaaattgctgttccttaatttgattaatttaattcatgtattatgattaaatctgaggcagatgagcttacaagtattgaaataattactaattaatcacaaatgtgaagttatgcatgatgtaaaaaatacaaacattctaattaaaggctttgcaacacanaaaaaaaaaaaaaaaaaaaagggggggg

SEQ ID NO: 9025 - DNA, 564 bp, Homo sapiens
ctgggaagccacgagaatattgtgaacctgctgggggcgtgcacactgtcaggaccaatttacttgatttttgaatactgttgctatggtgatcttctcaactatctaagaagtaaaagagaaaaatttcacaggacttggacagagattttcaaggaacacaatttcagtttttaccccactttccaatcacatccaaattccagcatgcctggttcaagagaagttcagatacatccggactcggatcaaatctcagggcttcatgggaattcatttcactctgaagatgaaattgaatatgaaaaccaaaaaaggctggaagaagaggaggacttgaatgtgcttacatttgaagatcttctttgctttgcatatcaagttgccaaaggaatggaatttctggaatttaagtcgtgtgttcacagagacctggccgccaggaacgtgcttgtcacccacgggaaagtggtgaagatatgtgactttggattggctcgagatatcatgagtgattccaactatgttgtcaggggcaatgcccgtctgcctgtaaaatggatg

SEQ ID NO: 9026 - DNA, 592 bp, Homo sapiens
ccacagtcttatatttttaatttgaatttactatctcctaagctagttgttttcaactatggagttttataaaaaataaaatgcctaggccctactgctgaatctctttacttcatatatttggtatattatgtctcataattgttatatctcaatttatttttctatataaaaattgtgttcctccatttttataaatcagatttttttaatgcaaacttaattattatccttagagacaacttgcctatttttttattttattttttggaatggctttattatctttggcatgctacagaagcaaccacatttctttactggttgcattataattatgcacccctcatctgacctgtcacatttgagggttaccagttataaattaaaaacagccactctaagtctctgtcatctacagatttttttttttcactctgaggcttgtgtgaatgccctggtataagctacaggccagattttgtgtcttcagccaaggacagtttcaggcttgtgtgaaggccctgctataagctacaggccagattttgtgtcttcaaccaagaaagacagtctcagagcttcatggaga

SEQ ID NO: 9027 - DNA, 328 bp, Homo sapiens
ctgtagagtgggcttatcatctttcaacacgcaggacaggtacagattcttttccttgaggcccaaggccacaggtattttgtcattactttcttctccttgtacaaaggacatggagaacaccacttgttgctccatatcctgtccctggaggtggagagctttcagttcatatggaccagacatcaccaagcttttttgctgtgagtcccggagcgtgcagttcagtgatcgtacaggtgcatcgtgcacataagcctcgttatcccatgtgtcaaagaagataggttctgaaatgtggagcacatgttgtttaggtataaaatca

SEQ ID NO: 9028 - DNA, 598 bp, Homo sapiens
  misc_feature (1)...(598): n = g, a, c or t
aaaagtgtgacgagaacatcctgtggctggactacaagaacatctgcaaggtggtggaagtgggcagcaagatctacgtggatgatgggcttatttctctccaggtgaagcagaaaggtgccgacttcctggtgacggaggtggaaaatggtggctccttgggcagcaagaagggtgtgaaccttcctggggctgctgtggacttgcctgctgtgtcggagaaggacatccaggatctgaagtttggggtcgagcaggatgttgatatggtgtttgcgtcattcatccgcaaggcatctgatgtccatgaagttaggaaggtcctgggagagaagggaaagaacatcaagattatcagcaaaatcgagaatcatgagggggttcggaggtttgatgaaatcctggaggccagtgatgggatcatggtggctcgtggtgatctaggcattgagattcctgcagagaaggtcttccttgctcagaagatgatgattggacggtgcaaccgagctgggaagcctgtcatctgtgctactcagatgctggagagcatgatcaagaagccccgccccactcnggctgaaggcagtgatgtgga

SEQ ID NO: 9029 - DNA, 576 bp, Homo sapiens
ctgaaaatcttttagtaaaagctttaaagatgagcccatgaattcactttaaatttcaccagttaaattaggtcaaatggaaggaactcaaatgagtattgcccaatcagagcccattatttgtaagtcatcagtaaccttaaaactccacttagacctaattattgaaaacttgcatataatgaagtgaaagaatttccattcatcaacctctcaatcccaggttttcaaagaaaaacctatctaaggaatacttaccaaaatcagataagaaaatttaaacctgcatagttatcagatttgttccactacaaccagtctgcatacagttacacatcaattcgttctgtatacactctagaactgaacagaacaaagtttagcatagaaaagctgtaagaaacaggttcctaattacggaagttgcaaagttcaaaagggtatgaaaaaaactaatgtaaattcgatacttccttcgtttcaaagaaatagactttctgtaaaaatatatacaatttttacaaatacatttacaagctgtcttaagaattgaggatatccatattcataactaat

SEQ ID NO: 9030 - DNA, 597 bp, Homo sapiens
ctgtggctgtctgtcagagaagcacatttttctgcagataattagaatggcttcccccatctctcacggactgtcccaagtctagaaaagaattgagttcctcttctattagtcaaataaaagggaagagaatgtttgtcttcctttcctttctgtagtgttaagaaaataaacgaacttaatgattctaaattatcagtgagcttaacactgtactatagaccaaagattaccttttcaaaaagtcctttgaggtgaaatattttgtatacgtaatacatagatgcacatataaacacacacatatagaatctcaatattttaacacttctttgggtagttgtactaactcactaaccctgaggaaaaagttaagaaattgaaagtgttttcttcaaaagttgagatttaacaataaaaggtgttactttgataactaaaaggaactttattatcctcttcctaaaataaaccaatgcctattctgaaaatggcacttgcaattacaatttgccattatcaaagctaccactgaggtagaggcattatctaaaacaaataccacttatcatttattggcagttacctcgagaggga

SEQ ID NO: 9031 - DNA, 581 bp, Homo sapiens
ctgggaagccacgagaatattgtgaacctgctgggggcgtgcacactgtcaggaccaatttacttgatttttgaatactgttgctatggtgatcttctcaactatctaagaagtaaaagagaaaaatttcacaggacttggacagagattttcaaggaacacaatttcagtttttaccccactttccaatcacatccaaattccagcatgcctggttcaagagaagttcagatacacccggactcggatcaaatctcagggcttcatgggaattcatttcactctgaagatgaaattgaatatgaaaaccaaaaaaggctggaagaagaggaggacttgaatgtgcttacatttgaagatcttctttgctttgcatatcaagttgccaaaggaatggaatttctggaatttaagtcggcccgtctgcctgtaaaatggatggcccccgaaagcctgtttgaaggcatctacaccattaagagtgatgtctggtcatatggaatattactgtgggaaatcttctcacttggtgtgaatccttaccctggcattccggttgacgctaacttctacaaactgat

SEQ ID NO: 9032 - DNA, 587 bp, Homo sapiens
ccagttttcatacagtctcggggttttaaaactttgaaatcaaggacacgacgtctccagtctacctccgagagattagctgaaacacagaatatagcgccatcattcgtgaaggggtttcttttgcgggacagaggatcagatgttgagagtttggacaaactcatgaaaaccaaaaatatacctgaagctcaccaagatgcatttaaaactggttttgcggaaggttttctgaaagctcaagcactcacacaaaaaaccaatgattccctaaggcgaacccgtctgattctcttcgttctgctgctattcggcatttatggacttctaaaaaacccatttttatctgtccgcttccggacaacaacagggcttgattctgcagtagatcctgtccagatgaaaaatgtcacctttgaacatgttaaaggggtggaggaagctaaacaagaattacaggaagttgttgaattcttgaaaaatccacaaaaatttactattcttggaggtaaacttccaaaaggaattcttttagttggacccccagggactggaaagacacttcttgcccgagctgtggcgggaga

SEQ ID NO: 9033 - DNA, 574 bp, Homo sapiens
cctcaatgacaagatgtttgagcatgacttccgttggactgatggcagcacactggtaagatgcccttgaaaatgatgtcaagttctaccttctggaaatttggtactgtgcactgattgtgcattacagagggtgcattagactggaggcaagttaaatgacttgctcaaggtcactcagtgaaacagagaagggttagaagagttccaagctacctgatccaacatccagtcctctcttcaatagttgtggttctcttcaaaagaggagtgtaccagatttctatcaaaccagaaaaccagacaattagtagaattgccttgggtctgtctttcagatggttatctttgctttttctagcttcagagcaaaaagagaagaataaaatgtagcagaaaaagtcattttaaaaaaatacctttccgtcttaaataattcactggaaatccgctataaggcatgactcatttccaagcaaaaatatccatttatttttatcttaaagaagactgttgatatgatcttgtgaatttctgccaactaattacatatttcaacttgttttctattttt

SEQ ID NO: 9034 - DNA, 449 bp, Homo sapiens; identical to SEQ ID NO: 8473

SEQ ID NO: 9035 - DNA, 109 bp, Homo sapiens
  misc_feature (1)...(109): n = g, a, c or t
ccagtggaatgatgttccctgcaattaccatctcacctatacgtgcaagaaaggaacagttgcttgcggccagccccctgttgtagaaaatgccnaganctttggaaag

SEQ ID NO: 9036 - DNA, 538 bp, Homo sapiens
ctggcaatgacaagactgggagtatcaaactaggattgttagttcaattaaaatttcagataaacaataatgtacttatactaaaaaattatttgttgtttatctgaaatgaaaatttaactgggtacccaattgtttgtttgtttaatctaaaaaccctgattgaaatttatctaataaaacatcatttaatatctaaaataaaataaatttactataacatctttataactattcaatcaatgattcatcttctatttttccaaattcttgcacaaatatttgatgcttaaataaatacataaataataaataggttaataagttacacttgaaaataatttatgttatgatgaaaaaacttaaagtgcttccacatgtcctcacaacatcactgtgaggtaagatggtggctaatactttttccacttagaaataaaggagaaaccaaggcacagtggaacaaggacttgtggatcctggctagcagagtagggttgccagatttaacagaaaaaaatccaggatttccagctaa

SEQ ID NO: 9037 - DNA, 521 bp, Homo sapiens
ccatcggtgctgaaattgagcattttaaatagtacagtaggctggtatacattaggaaatggactgcactggaggcaaatagaaaactaaagaaattagataggctggaaatgcttactttctgctctcattttctttcattttgtctgctgtctttttgaatgccaatactttcatttaaaatgttttgggagcacggcaacccaaaatgactgaacggtggtccaaaaatccaaaccaactgataattacttctcgaggtgataggaaaggcacaggaagttaggactttggctgaaatgatgaaaacacatgttcgccattttagggatcagcgcctcgactcctgccacctccggctccaacgatgatcatgtttggatgtatttattgaattgtcctttgctgatgaggaatttttaaagtatttcatagaataagtcctttggtatgcagatgctacatggaaggaaagaaagaaaaaaagaaaacacacaatattacttgctccatgccctaaa

SEQ ID NO: 9038 - DNA, 525 bp, Homo sapiens
ccaaataactcccaaatgaaacactcaacccaaggatgttttcagcccactgttagtgaagctgggtgcagaatgcaaagcctctaaaaggagaggatacaaagtcaggtgagtaggggccattggcaatgctcagagccagccagactccaaacagggagcccaagtggtttttttctgggacactctacttgaattattgtttaattagtcaaccatagatcttcaaaagagaacaattagttaacatgataaaaagtgactgcattctttggactgtatcataattatagtaagcaaattctgacagttttaatgaaaatagcctccaccattttgcaggtatgaagataacttaattatccacagggcttttaatgtctgctggacaatacatgaatgataagctataaatgacattgttttatgatataaaaatactagtttttttcatttattatttctataggcattcactgtttgagtcaaggttaggcttgttaagtgattaaaggcaattttatt

SEQ ID NO: 9039 - DNA, 371 bp, Homo sapiens
cctcgagtgcgatatggcaaagccaaagctcccatccaagacatctggtaccacgaggatcggattagagcgtgagtgctcagccctgtagtggacaggaggcaacagaacttcagaagggaaggtttcggtagcagtctgggaattcaaacatgaaattgagtcaggggtttgccctgtggagaaggcttatctagccaaattagggaggcagcaccccttcctcatagtgaaactgaagttctgaaaagtggaatctggagcccagcaaccgaaagatcattgcaattatagccgcatgtttctgggcatctgctttgggccaggcactgtactaagctctttgcaagcattatctcattctctaaagg

SEQ ID NO: 9040 - DNA, 590 bp, Homo sapiens
  misc_feature (1)...(590): n = g, a, c or t
gccacactctacttctgcttctgccacctatggggtcgaggcaggtgtggtgccttggctaagtccacagacttctgagaggcccacgctttcttcttctccagaaataaaccctgaaactcaagcagctttaatcagagggcaggattccacgatagcagcatcagaacagcaagtggcagcgagaattcttgattccaatgatcaggcaacagtaaaccctgtggaatttaatactgaggttgcaacaccaccattttcccttctggagacttctaatgaaacagatttcctgattggcattaatgaagagtcagtggaaggcacggcaatctatttaccaggacctgatcgctgcaaaatgaacccgtgccttaacggaggcacctgttatcctactgaaacttcctacgtatgcacctgtgtgccaggatacagcggagaccagtgtgaacttgattttgatgaatgtcactctaatccctgtcgtaatggagccacttgngttgatggttttaacacattcaggtgcctctgccttccaagntatgttggtgcactttgtgagcaagataccgagacatgtgact

SEQ ID NO: 9041 - DNA, 334 bp, Homo sapiens
ccagcatcctcttggatctgcagttaggctcaacacattccagccttagcacaatcttctttgtggtcttagccttcttccggaaaattggctttgtctgcccaccatagccactctgcttccgatcatagcgcctccttccctgggcatacaaagaatccttgcccttcttatactgtgtcactttgtgaggctgatgcttgccacacttcttacagaaggttcttcgggttttaggtacgttgaccatctttgcagcagggctgttttgtctatatgatgaaaacgagaaacagcgcccgacacctggcccttcgcagctctcgcctttcgc

SEQ ID NO: 9042 - DNA, 597 bp, Homo sapiens
  misc_feature (1)...(597): n = g, a, c or t
ccatcggtgctgaaattgagcattttaaatagtacagtaggctggtatacattaggaaatggactgcactggaggcaaatagaaaactaaagaaattagataggctggaaatgcttactttctgctntcatttnctttcattttgnctgctgtctttttgaatgccaatactttcatttaaaatgttttgggagcacggcaacccaaaatgactgaacggtggtccaaaaatccaaaccaactgataattacttctcgaggtgataggaaaggcacaggaagttaggactttggctgaaatgatgaaaacacatgttcgccattttagggatcagcgcctcgactcctgccacctccggctccaacgatgatcatgtttggatgtatttattgaattgtcctttgctgatgaggaatttttaaagtatttcatagaataagtcctttggtatgcanatgctacatggaaggaaagaaagaaaaaaagaaaacacacaatattacttgctccataccctaaactgccgataccacagncgtaaaatgaaggtgtctantagttgttatagcacggtagtccattctttctaaggacca

SEQ ID NO: 9043 - DNA, 337 bp, Homo sapiens
  misc_feature (1)...(337): n = g, a, c or t
aaaagattgatcgccgttctggtaaaaagctggaagatggccctaaattcttgaagtctggtgatgctgccattgttgatatggttcctggcaagcccatgtgtgttgagagcttntcanactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattgg

SEQ ID NO: 9044 - DNA, 265 bp, Homo sapiens
  misc_feature (1)...(265): n = g, a, c or t
ccttcaaagaattcccatccagtccaagtggggaggatcatactagaagactaccatgatcatggtttactgcgcgtccgaatggtcaaccttnaagtggaagattctggactgtatcagtgtgtgatctaccagcctcccaaggagcctcacatgctgttcgatcgcatccgcttggtggtgaccaagggtttttcagggacccctggctccaatgagaattctacccagaaggtgtataagattcctcctaccaccactaagg

SEQ ID NO: 9045 - DNA, 300 bp, Homo sapiens
ctgccacatccctgggcttacggtgcagcaggtgcttttttcaagacaggaatcaaaatgttaggaacacggcagaaaggggacacctggagaccaaacgcaggatgaggagttctgcagaggtcacagggaagtcacagaacagtaatacgctagcaggggcatggggcgtgaagaacagaagaagagaggaagcgtttccaagcctccagagaagaaatcaaggccaaccaaagcttcccgggtcacagaaccaattcttttaccaggcagtaccactgctgtcatttcagcttctgg

SEQ ID NO: 9046 - DNA, 518 bp, Homo sapiens
  misc_feature (1)...(518): n = g, a, c or t
ccatcttaagttaaaggccctttatcataaaatatatggttttaaattttactcaaattgaatttataatccctatgacttccctacatntacataacaaaagngtgtagtaaaattagcaaatactaaactatattgataatttatcattcttagtttgtggtttttagaaacagtacacgcacctaatatatgtcgattccttggcttattagttgcagtgtacaatgcaacaaaatacaaaatacatgcttggtgaacattcgttcatatctacaagacggcagctagagattaggtttcaatactgaccatttactatcctacaagcaattagcattacatcataatatgccatcaaggcaactttttttatactgaaaaaatcaaaataaaaaccgntatttgtaaacttttatacgaaatgtaactcttcaagtggaaataaaaaataaaatttgnctatttactattgaatacacataggatttcaattttcattataccgagaaaaaagc

SEQ ID NO: 9047 - DNA, 207 bp, Homo sapiens
ctgtattactactgtttctatatttatgattaattactagcagtacaactcccagaaggaaggagatggatccaacagcgatgtaagcaatccccaaaaatggattttttcctcccatccatgaaatagtgctcaagatcatccgttttcgtccatcaaaataatgtacagggtaattgtatgtgacattcaaagagtatcggccag

SEQ ID NO: 9048 - DNA, 597 bp, Homo sapiens
  misc_feature (1)...(597): n = g, a, c or t
ccttcattagaataaagtatatcttaactacattttgcaaagaaatgaagcaatggttgcacaaccagtcagggccaagttagtaacatacaactcagccatcagcccacctctccttcaaactaaactaatctaaatgtatttttcagaaaatttcctccatactccatgtatgtgttacatacatccaatcatatccatattttggatcatttttttctatattcatcagattattggttaaaatgcacagcaagtagaaatgatccatttcaaaattcttaatatctagcgttctctgtaaaacaaaagctgacaacagttttattgtactcctattaaatgtaggtgcatgttcattaggacatctgagctatttttaggaccttcagaaactggtgtgattcactttggccctctgagatagaaatgccatcttagtatttactgtgactacatacctcttttgttaaaacttgaccctgagttttgagtgctggaatataaactgtaaaatggaaaacactccaaaatacattagctaatattggtgtctctacaatactgngctttttctctccattaacataatgcacc

SEQ ID NO: 9049 - DNA, 596 bp, Homo sapiens
  misc_feature (1)...(596): n = g, a, c or t
ctgcacatggattggntaacataatatatactgctatataatcttttaagggctaatatttgtagataatttaaaagcatgtcaatttcctctaagatttgattatttaacctgcacaaaggccaatcttcagttatcaatgacaagaaaactctagggctgccaaaataacttcattttagaccccagagttagtgttaggctggtaatgtttctaatttgggaataatgagactagaaagctaggagggccccctccaaatttctcccttgtattaggctgaagtagaacataacgtggcttaaagcataaacttaaagcatatgctttgagttttaaaaatgttaacctgtaattaattattagagtattatccatagtctactatgatagtcagttaatattctctaaatcagattatattcatttgaaaatgcatctgcatatttgcaaatgtgttattacacaagatcttacctatgtcaatttaaagaggttaaagatgcaggaagcccccactaaaatgtaaacacatttgtacggttttcagaatgtttggactcattctttcccattgacagagcagtangtttta

SEQ ID NO: 9050 - DNA, 506 bp, Homo sapiens
tttttatgcagtgcattcattgtaaactataaataacatttgtattaaaaagaaagctgggtaatacaaaaataggagagactctgaggagcaggcaatctgttgaggctcagtatatcttatttgctttgtagtctgctgtcattcctttcaaagagcacacagcacatgaggcatagtaatcatctgtcttgttaacctctctaatttagaaatctgttgttcgtaaaactggaccaattatcacaaactatcatttgcataattaaccgcaagtctgttacaaagcattttgttagtggtatcaacaaatgcaggaggatggacatttataaaaaatgggttttgttaagcttgccaactccttagatatcatggactatactgccatttcacgatttaattagatatttaatgcctcaagtaaaagactgatcaatggaagcaagcaaaactaaattattttctaggtgctgtaatatttcatttgataaggtaacaaaagg

SEQ ID NO: 9051 - DNA, 390 bp, Homo sapiens
ctgtgcccaggaaatggctaaattcatttcaaaaaacaaacacgtgagcctgtgcatcttcactgcccgcatctatgatgatcaaggaagatgtcaggaggggctgcgcaccctggccgaggctggggccaaaatttcaataatgacatacagtgaatttaagcactgctgggacacctttgtggaccaccagggatgtcccttccagccctgggatggactagatgagcacagccaagacctgagtgggaggctgcgggccattctccagaatcaggaaaactgaaggatgggcctcagtctctaaggaaggcagagacctgggttgagcctcagaataaaagatcttcttccaagaaatgcaaacaggctgttcaccaccatctccag

SEQ ID NO: 9052 - DNA, 225 bp, Homo sapiens
  misc_feature (1)...(225): n = g, a, c or t
aaaatttcatcactaaaatgatctacaggtctatggaaaaatgtgtaancacataaaatacacaaacctatttttttaaaaatgagatacttaaaatttctttagcataccaacaaaaaatgaangtagcattgccattttactacagatgtgcngacattccaaagtccaccnattgttcgtatatatnggctcaacangtnatatttnagaatatactgctgg

SEQ ID NO: 9053 - DNA, 134 bp, Homo sapiens
  misc_feature (1)...(134): n = g, a, c or t
ngnccatggaaacatagtatnaatcatttgtgtatctaaatataaagacatataaataagtaaggaagtatagtcccgtggaaccaccatctgttactggcagaaactttgttatgcngnaaataactggattt

SEQ ID NO: 9054 - DNA, 256 bp, Homo sapiens
  misc_feature (1)...(256): n = g, a, c or t
ccaaggacttgacaaagacctgtgaatttatcgttcactccgctcctcagaaggggaagtttactcccagtcccgtggacttcacgattacacctgaaaccttacagaacgtcaaagagagagctttgcttcccaaatttctccttcgangacatcncaacttaancaaactgtntcatcacggcagccactaacgnggagagctggtggtggagagctcggaagccgccatcagaagcgtggagctgcanacctn

SEQ ID NO: 9055 - DNA, 269 bp, Homo sapiens
  misc_feature (1)...(269): n = g, a, c or t
aaatatgacctctgttccctgaagaaaaatcatatcaaagactctggctacgaatcccagcgggaactgtgaggcaaacatggtgaggaaccagggggcagcgtagaggctggggccgatctcgtgctcctccaggngattgtagaggtctctgtggtantcatgaagcaacctcnagagcttggtacatctggatcttgtaaaataatcatgtctggccgatactgtttccgcagccccatgtcaaacatcagaaacttgagcatttt

SEQ ID NO: 9056 - DNA, 363 bp, Homo sapiens
  misc_feature (1)...(363): n = g, a, c or t
aaatatgctgcatagacnnctggaccatattttgtagccattaaattttcaaaagactgggtccactgtaatacttcctccaaagtaaggtttgaagggggcctcttagattcatctctgcacatcttacaaatccaacaattccgcctgctcattttncaaancttnaaataaacaatgatcatttttttctcatgttggtggnataatatgtggaaacattccattgacaaatatatcctgtcgagcagtccaccatgctaaatttgatctcctctttgttatgatccgtttgaaatcaggttctgaaattttgtgagacacccagcattttatttttcccanagnaaaagaattttactg

SEQ ID NO: 9057 - DNA, 196 bp, Homo sapiens
  misc_feature (1)...(196): n = g, a, c or t
cntggccgaggnaaatatcacaagtaggtgggtaagtgtcatctggcatcttctttctgtagccaggtaactcttagatcttattcatcagcctgctgaacagntcctttttnagagacatagataccatccaaaaatttcctgatatccttgcttttaactgttgnggctcgctnaaatcnanancccttgaatg

SEQ ID NO: 9058 - DNA, 102 bp, Homo sapiens
  misc_feature (1)...(102): n = g, a, c or t
aaaaaaggttctgaaatnnncatacaagcatgctggacaatcccacccttttcccctccccatttcccctttttttgttcaaaccatggtaagagttctgat

SEQ ID NO: 9059 - DNA, 593 bp, Homo sapiens
  misc_feature (1)...(593): n = g, a, c or t
ttggcgtaatcatggtcatagctgnttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccatangctccgcccccctgacgagcatcacaaaaatcgacgctcaagtcagaggnggcgaaacccgacaggactataaagataccagcgtttccccctggaanctccctcgtgcgctctcctgttccgaccttgccgnttaccgganaccttgtccgctttctcctttgggaa

SEQ ID NO: 9060 - DNA, 249 bp, Homo sapiens
  misc_feature (1)...(249): n = g, a, c or t
aaattgacctcctcagntaactcagcagaacccagcatgtcagcagtaaattggtcaatatgagcaactggcttggttccaattgtcttacaaatgaattcaatgtcttctctttcaatatccttaatcaccatgatcttcattttattcagaaagtgtaatgcaagatcactaagagcatctcttagaatagatttctgtatgagaaggacattacatcctgtttttttaatttgcttcactaaattt

SEQ ID NO: 9061 - DNA, 373 bp, Homo sapiens; identical to SEQ ID NO: 4043

SEQ ID NO: 9062 - DNA, 209 bp, Homo sapiens
  misc_feature (1)...(209): n = g, a, c or t
ttttttttgactcaaaaagtnacatttattcaaagaaaaaaaangacaagatgnccatcccttggctcccttccctcccccctcctgctgctcctcancccccagagattgagccctggctggggctgggtggcaggacagcccctcacatgaggtcagnancattgagggggcntttcctcaatggaggtgnttgnataaggtctcaa

SEQ ID NO: 9063 - DNA, 117 bp, Homo sapiens
cctactgctgagttcttatttatttaattgcttattgtcagtctcttccccacagaatggaagttccatcaaagtagagattttgttctctcttgttcaggatctgagtctccaagg

SEQ ID NO: 9064 - DNA, 434 bp, Homo sapiens
  misc_feature (1)...(434): n = g, a, c or t
aaacataaaagatattcagagttttgggtcaactgcatctttctggagagtttagtttcttgttaagncaatttgtgtattttcattgagcatacatccttaacaaggtttcatacatgctggcactttgagggacagncaagggacattctgaaanaactcccaatngactggggatcaggagattgaatntcaaattatattttcgcccattaatctgactctgtaaacttgaaaaagncatttcctttctctgggctatgtggaagttcctttttttataaatgacaaatagccttatcatggaatcatagaanattaactttagaggtggtttagagcccatcctcattttncaggcccaaagaaatgaantgagtttngtcagtcaatacgatagctcctcctggggaaaaaaaaacaaaaaagaagtg

SEQ ID NO: 9065 - DNA, 354 bp, Homo sapiens
  misc_feature (1)...(354): n = g, a, c or t
ccaccctcactgtgcaccccgtggatgttctgcgcacccgctttgcagctcagggtgagcccaaggtacggagatacaagggcctcatggactgtgccaagcaggtgctgcaaaaggaaggcgccctgggcttcttcaagggcctgtcccccanttgctgaaggctgccctctccacaggcttcatgttcttctcgtatgaattcttctgtaatgtcttccactgcatgaacaggacagccagccagcgctgagcgcaggaaggaccccaggtcttccctggaggcagcctcctgaaggaaggaagattcagtctccactgagaggtgccgtctggcccttccctgcaggccag

SEQ ID NO: 9066 - DNA, 136 bp, Homo sapiens
  misc_feature (1)...(136): n = g, a, c or t
tggacctgaccnccgtntgatggacctgaccgctgatganggacctgatcgcngnntgatggacctgancgactgtatgangngacctgacccccgtntgagggacctnacccgttgnntgatggacctgaccgcc

SEQ ID NO: 9067 - DNA, 472 bp, Homo sapiens
  misc_feature (1)...(472): n = g, a, c or t
aaaaggtaactttttaccaattttttgatcttcattagctggagtcaatgagtccaaggctggaatacatcgaaggagggcacaaccccctcccaaaacaatgccttcttcaacagcagctcttgtagcattaanggcatctgnaactctgnctttcttttcattcacttncaacatcacttgtcccaccaaccttcagcacagccactccatctgaaagttttgcaagccgttcattcagnttttccttttcatattcactagttgtgacatctaacngctcaatgatttcttgaatacgnttttcaatttgagccttgtcacctttncctttnaagagcatggcatcgtctttggtcacaatgacctctccaacttttcctaagtcatgaggctgaacgtctncaagattcagggncaatccctcttctccaaacactgcaccaccagtagcaatagccatatcttntaa

SEQ ID NO: 9068 - DNA, 112 bp, Homo sapiens
  misc_feature (1)...(112): n = g, a, c or t
ccgaggtaaaaaagagcaacagtggggaagcggctcccctcccccaagncatnntggctggcacactgtctgagcatcaccctggntttcaaagcgcgtcagctncaagacg

SEQ ID NO: 9069 - DNA, 306 bp, Homo sapiens
  misc_feature (1)...(306): n = g, a, c or t
tgatcctgnggatgggaaattttttgatcatgcggcacatcttgggggagctctttttggaatatggtatgttacttacggtcatgaactgatttggaagaacagggagccgctngtgaaaatctggcatgaaataaggactaatggccccaaaaaaggagggggttctaagnaaaactgggattggacantagnggtgcatctggtccttgccgcctgagagccccaggagacatcggctagagngaccatggctatgctcccgtctggaangatgccagcatntggcctcccactgnttttcag

SEQ ID NO: 9070 - DNA, 231 bp, Homo sapiens
  misc_feature (1)...(231): n = g, a, c or t
ctgccaaccctgtctacggcaggnatgaccagtataagactccaatgganaacattgggctacaggactcactgctgtcacganttgacttgctcttcatcatgctggatnagatggatcctgagcaggancggnagatctcanaccatgtccttcggatgcnccgctacagagcacctggggagcaggatggcgatgctatgcccttgggtagtgctgtgnatntcctgg

SEQ ID NO: 9071 - DNA, 299 bp, Homo sapiens
  misc_feature (1)...(299): n = g, a, c or t
ncnnggccgangtcctcaatcacaactttgnnagcagcngaaccggagggagccgcantgtacgccacaccactccttttagctctgtctacgttatctgggaaagggaagaaagcatcanagctgatagaaacttcagacaggttctnaacccattccttcttctctgcctcagtgagnnactgagggactncctcaaacagngccttccactttatcaaannttgatcctcgncaatggntccagtcacatattgatcgatggcatnggaganttctgctctcttcactccngnttt

SEQ ID NO: 9072 - DNA, 287 bp, Homo sapiens
  misc_feature (1)...(287): n = g, a, c or t
gcttactggntcccgaaaatagacaccttcntgagtcagacccctatgggnaccggcctttctcaaatatnagtnagcaccctcaatcccactgctaaacgacnttttggtcctcgctctgccactatgactccaagtattttntcccactggaacaacacantgtttgtaggagccactgattcnncgtgccatggcgcaatgatgntggaacttgctcgtgcttagacangaaactcctttccttanagactgtttcagactccangccagatttgcactccagc

SEQ ID NO: 9073 - DNA, 402 bp, Homo sapiens
  misc_feature (1)...(402): n = g, a, c or t
ccaccacacccaattccttgctggtatcatggcagccgccacgtgccaggattaccggctacatcatcaagtatgagaagcctgggtctcctcccagagaagtggnccctcggccccgccctggtgtcacagaggctactattactggnctggaaccgggaaccgaatnnacaatttatgtcatttgccctgaagaataatcagaagagcgagccccttgattggaaggaaaaagacagacgagcttccccaactggtaacccttccacaccccaatttttcatggaccacagatctnggatgttccttccacagttcaaaagacccctttcgtcacccaccctgngtatgacacttggaaatggtattcagcttccttggcactttttggncagcatccca

SEQ ID NO: 9074 - DNA, 554 bp, Homo sapiens
  misc_feature (1)...(554): n = g, a, c or t
ccaaacccccgtctctacaaaaaaatacaaaaatcagctaggcgtggtggtgcgcgcctgtactcccagctacttaggaggctgaggtgggagagtcactggagcctgggaggtcgaggctgcagngcaagattgagaattgcaggattgcactgcaatccagcctgtgctacagagtgagatcctgtctcgaaaaaaaaaataaaaaaataaaangggcctatcaatgcnacgttcctgcaaggcattgataatataaatgcaaaagccaccgcaaccaaaaaggctataatgctngcctgaatctagtacataagcaggataatgacaatcactttntgnttataaatttgtagatgtcttattatttcagtcagcatgaggactgcattnatatttgngggtggcagctctcaaanttatttatccatagnccagatttgttttgttgcatttgctctnaaaatgcattgttgtatactccatcacagaaggngtcaaaatactcctgctgcctttnnaaaatgttgcaaaaccctaaacctgtanttttc

SEQ ID NO: 9075 - DNA, 240 bp, Homo sapiens
  misc_feature (1)...(240): n = g, a, c or t
cctcgccagcctcagtcaaatgtaacgttcctaggccaagccacgaattgcccaactgggtggtccggctgccctgctatctcacttgtttgtgngcttattgtcaactctacctatgaggagtgagctcctaaaagcaganatttgggcagcgcaggnngctcacacctgtaatcccancnctttgggaggatgaggcggggcggatcacctgagctcaggagttcaanaccagcctgg

SEQ ID NO: 9076 - DNA, 194 bp, Homo sapiens
  misc_feature (1)...(194): n = g, a, c or t
tttggggctcccagnggttccctaaatttgagggatggaggaagacttcccttgccccaccccaagcctnccgancctggtggatnggtccctgtccccacncaacctggtggcacgggtggggcttcccgngctaataacccccctttttccttcttgtnngaccngctcccctcaaaagcttcncgccaaca

SEQ ID NO: 9077 - DNA, 80 bp, Homo sapiens
  misc_feature (1)...(80): n = g, a, c or t
ntatacagcacttatatcttttannccacaaccgatattatttaaatgatatgacancatntaatncaaccatttctccn

SEQ ID NO: 9078 - DNA, 345 bp, Homo sapiens
  misc_feature (1)...(345): n = g, a, c or t
ctgctgcacatgatgcaggaatcactatcttctctgttggtgtggcttgggcacctctggatgacctgaaagatatggcttctaaaccgaaggagtctcatgctttcttcacaagagagttcacaggattagaaccaattgtttctgatgtcatcagaggcatttgtagagatttcttagaatcccagcaataatggtaacattttgacaactgaaagaataagtacaaggggatccagtgtgtaaattgtattctcataatactgaaatgctttagcatactagaatcagatacaaaactattaagnatgtcaacagccatttaggcaaataagcactctcttt

SEQ ID NO: 9079 - DNA, 167 bp, Homo sapiens
  misc_feature (1)...(167): n = g, a, c or t
aaaactcttataataagngtnctaatagtaatatgaaacctgcttactgctcctttgtctgatacctgcatttctccaaatgataaaaaactttgtcacgaccttagttcaccaaaatgctttagcagnaagcatactatctaancncactatcantctnttgcaca

SEQ ID NO: 9080 - DNA, 244 bp, Homo sapiens
  misc_feature (1)...(244): n = g, a, c or t
ggnatctggcaggtgctaaataaatgtttcctggatcgaaatctacagtctcaaggagtcaaggctacaattcttaagttgcttcagatgactggttctatctatttatcaatacatccatcgatccactcatncctcatccatgcatnctcctacccttcctcttccccgtcaaacattcatccatccaattggtggcttggggaaagggacaaaaaggggaaaaaaaaaaaaaaaaaaggaa

SEQ ID NO: 9081 - DNA, 296 bp, Homo sapiens
  misc_feature (1)...(296): n = g, a, c or t
cctctgagcagaacgaggtaaatcttcactgttagctacaaagagcactgcatgaaagtgtgtgcaagatgactccatgaggttttctttttaagtttatgtatatttacagaaaagtgaaatgtgttggaagaataaacaccccttcttgtggacacttttagagaggagaattttgggctgggaaaaaaggagancctttttatttttttgctgctctctactgtttgtcttttctgtagntaatattaatattaattgtattaatattctgactttaatattagaaacttttt

SEQ ID NO: 9082 - DNA, 149 bp, Homo sapiens
  misc_feature (1)...(149): n = g, a, c or t
aaagaaatatataactatttattaaccactgttcagtatttacaataaagtaaacaatatacagttggataacattttgattactacaaagttgttcttcctggcttttgctgaaccagnaaagcaaactcaagattgagcctccatgt

SEQ ID NO: 9083 - DNA, 338 bp, Homo sapiens
  misc_feature (1)...(338): n = g, a, c or t
ttcgaatcaccctaacaagccgcaacggaaaatncttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcantattgagccaggagttgaggtggaagtcaccattgcagatgcttaagtcaactattttaataaattgatgaccagttgttaa

SEQ ID NO: 9084 - DNA, 170 bp, Homo sapiens
  misc_feature (1)...(170): n = g, a, c or t
ccatttatgaagatgaagaatacagtcagctttgtgaaanagnattgcaagcaagccccgtgggcaaatttgtattgagtccatctgtaatttgctcagtgatggcagacaagatggctgtctggttttgagacacactttaattttatgttaacttgttaaatcttttt

SEQ ID NO: 9085 - DNA, 600 bp, Homo sapiens
  misc_feature (1)...(600): n = g, a, c or t
ctgttagagtntttagagtcctgagataacaaggaatccaggcatcctttagacagtcttctgttgtcctttcttcccaatcagagatttgtggatgtgtggaatgacaccaccaccagcaattgtagccttgatgagagaatccaattcttcatctccacgaatagcaagttgcaagtgacgaggggtaatacgctttacctttaagtcttttgatgcatttcctgccagttcaagtacctctgcggtgaggtactccaggatggctgcgctgtacacagcggcagtcgcgcccacacgtccatgactggtcgtcctagattttaggtgtcgatgaatacggcccactgggaactgcaagccggctctctgcgagcgggaaaccgcctttgtcttggcctttccggagtcctttccagccttaccgccagccatttcgaattccgctgaagctcaagcaagcaaggcagagaaaaggctaatcggacccaccggtgagatcccaccacctactcctttcgacctgcccgggcggggcgctcaaanggncgaattcttgcannatatccatcacacctgggcggggcgcttcgangcatg

SEQ ID NO: 9086 - DNA, 373 bp, Homo sapiens
  misc_feature (1)...(373): n = g, a, c or t
ctgtagcttttgtgggacttccactgctcaggcgtcaggctcanatagctgctggccgcgtacttgttgttgctttgtttggagggtgtggtggtctccactcccgccttgacggggctgctatctgccttccaggccactgtcacggctcccgggtagaagtcacttatgagacacaccagtgtggccttgttggcttgaagctcctcagaggagggcgggaacagagtgaccgagggggcagccttgggctgacctaggacggccagtttggtccctccgccgaagacgacatggtcattattacgatcccacacttgacagtaatagtcggcctcatcgccggcttcgaccctgttgatggtcagggtgg

SEQ ID NO: 9087 - DNA, 474 bp, Homo sapiens
  misc_feature (1)...(474): n = g, a, c or t
tctgaattttattagagctcacacaccatatattaacatatacaactgtgaaccagctaatccctctgagaaaaactccccatctacccaatactgttacagcatacaatctctgttcttgggcattttgtcagtgatgctgatctttgccttcttccaggaacttgtaatagctggcatcgttgagaatgaatggaaaagaacgtgctccagacccaaatctaacatagttctcctgtcagcagaagaaaaaaagaacagactattgaaataaaagaagaagtggttgggctaactgaaacatcttcccaaccaaagaatgaagaagacattgaaattattccaatccaagaagaggaagaagaaagaaacagagacgaactttccagaacctccccaagatcaggaatcctcaccaatagaaaatgacagctctccttaaggngatttcttctgntttctggttcctttttt

SEQ ID NO: 9088 - DNA, 383 bp, Homo sapiens
  misc_feature (1)...(383): n = g, a, c or t
tngcaactaaagacacaagcctgaagaangaactattgaggatacctccaccgtctcccaaaacaagaaagaatcacattgatttaagataaaattttgccataagtcactaaattaagagtttttcgaaagagaaggcgcagtantcatcgtgagtgtttcactgaaagacagagctattttatttatttaatttgctccagccgttggcaaccagccactacaaatgggcctcttgngatcattnaaccggcagtatttattaaatttgtccttcagatgctgncggtattgttctctattgctgtagaaagactggttattanccntaaatgactgtatttcatcttgtgagataaagatttcctgatctganccncatt

SEQ ID NO: 9089 - DNA, 597 bp, Homo sapiens
  misc_feature (1)...(597): n = g, a, c or t
aaataaganntttctttaatcaggtatccctttggactgggagagcngtttatatcatagctttgcagcataatctttttactctcaggctcttcaagcatttttatcttctttgaaacttctatctaaacaaaaatagtattaaaaaagataacagaaggggttagattctgccaatgaactgtggacatcagtatctcattcttctatttgcctccttattctagtttgaaaaagctttggaacacattattacctatcattattacatatttcttgtagctttagtgttactcccccgactggaaatagaagttgctctttaataaggcccagggtgcttagggagcaatgcgagatttttcttacatctcttgggccaaccctatacaactaattctgggaaagggattgttataatacactgtccttgaaaagtttctttcagtccatttggagaaatgttgggataaagataacttagtgcttacaagntgctctattattagtaggtataataaccntaattattattaaacctaanagttatctattactttatcaccctntctccaatttatggntttctcctctttt

SEQ ID NO: 9090 - DNA, 305 bp, Homo sapiens
ctgtcttttggaggacgtacgtaataaggttttaatttagtaaaccaatcctatgcatggtttcagcactagccaaacctcaccaactcctagttctagaaaaacaggcacttggcagccttgtgatgtcatacagagaagtcacagggcagtacctgagggtctgtaggttgcacactttggtaccagataactttttttttctttataagaaagcctgagtactccacactgcacaataactcctcccagggttttaactttgttttattttcaaaaccaggtccaatgagctttctgaacag

SEQ ID NO: 9091 - DNA, 664 bp, Homo sapiens
  misc_feature (1)...(664): n = g, a, c or t
ctgaggcatnnttcctgggccagagtcgngtccaccaagggacagtanccaganctcctcttcctttaccaggcaaggtgcatcccctcagccctcctggcccttcagtcttggtgccacctgggcacaggggcaagcttggtggctgngagtccattcatctatcagagctggaacctcatccctgcacagatgaggaaaccaaggcatggagcagtncccagagtcgaatctanatctcatctgtcatccgggncttatcctttgctctgtttttctcttcaggctctggaaaatcagatctgtgacttaatcttcctctccctggccctcacccacttagnttctttttcattcctgctccctgccttaactcctcctcccactgcccctgatcccaggcccaggcttttacaacctggtgctcagcttccccatcagttgaaaaggggtggctagagnaactaacctcagcaggccgtccagccttgatagtctgnggatttcggatccttctcaangaagcttcatgtctaatgggagactataattataactcctgttctgcatagagcatttgcatcaaaggctttccatacccctccctcccctggtcctcataagaatccttgaagnangntcctattcctnattggcnaccatg

SEQ ID NO: 9092 - DNA, 451 bp, Homo sapiens
  misc_feature (1)...(451): n = g, a, c or t
cctacagacttatttcttcttggacacacccacggtgcggccacggcggccagtggtcttggtgtgctggcctcggacacgaaggccccagaagtgacgcagccctctatgggcccgaatcttcttcagtcgctccangtnttcacggagcttgttgtncanaccattggctaggacctggctgtattttccatcctttacatccttctgtctgttcaagaaccagtctgggatcttgtactggcgtggattctgcataatggtgatcacacgttccacctcatcctcagtgagttctcccgccctcttggtgaggtcaatgtctgctttcctcaacaccacatgagcatatcttcggcccacacccttaatggcagtgatggcaaaggctattttccgcgcccatcgatgttggtgttgagtactcgcaaaatatgctggaacttttcag

SEQ ID NO: 9093 - DNA, 409 bp, Homo sapiens
aaagtcatgtttattgaagtatgattttacattcagcaaaattcatcctgttaaggtttgacaaacgcacagtcataccataatcaagatgcagaactgtagaatcacactaacaattccttcctgcccttgtaatcaacccctttttgatcccaaggaactcactgacctgtttttctgtcaaaagtatcaaatttcatcactaaaatgatctacagtactatggaaaaatgtgtaagcacataaaatacacaaacctatttttttaaaaatgagatacttaaaatttctttagcataccaacaaaaaatgaaggtagcattgcattttactacagatgtgcggacattcaaagtccaccattgtcgtatatatggctcaacagtaatatttaagaatatactgctgg

SEQ ID NO: 9094 - DNA, 215 bp, Homo sapiens
  misc_feature (1)...(215): n = g, a, c or t
gttgtctaccttnttttcttcctcatttccttcttttattcctccccaccccaaccccttaaaaaaaaggtcagaaggacaaagctggtttgtttgggaaatggactgatcgaaagaaaacttgccaaagtggaaaggtggcttttagcattctgtgtttccaaataatgaatttgaacaccaggttgggttaattaaagcttttggtataattt

SEQ ID NO: 9095 - DNA, 408 bp, Homo sapiens
  misc_feature (1)...(408): n = g, a, c or t
ctgcaatgtggccttgattttctcatcagtaaaatgggaaagctggatttggaggctggaagagatctcacagcttgaccaccctagtaggagggagggagaccagacggaggccaggcaaccgacccaggcagcatctggctcagacgcagacacatcttcatgttgagggacctattcttacacagcaaaacccagagaagtcgactgctcagcctgagcctgtcatccctatatagactcancttttaggagaagagggagagttgaggagatagcatcgctctctgtatcagtgtctgatgatctggagtctgcccctggggtcactcagtcactcaacaaacatttgttgagctcttaacgtctatangggngtgagctctgcccttcgaggctgtatgtctc

SEQ ID NO: 9096 - DNA, 373 bp, Homo sapiens
caggacacagcatggacatgagggtccccgctcagctcctggggctcctgctgctctggctcccaggtgccaaatgtgacatccagatgacccaatctccttccaccctgtctgcatctgtcggagatacagttacaataagttgtcgggcctctcagaatatagatcggtggttggcctggcatcaacagaaaccaggcaaagcccctaatgtcctaatttatgcgacttccagtttagaagaaggggtctcattaagatttactggcagtggatctgggacacaattcaatttaaccatcaccagtctgcagcctgacgattcagcaacttattattgtcaacattattctgcatctcttcgcagttttgg

SEQ ID NO: 9097 - DNA, 482 bp, Homo sapiens
  misc_feature (1)...(482): n = g, a, c or t
cctttggggaactgggatgcttatttcctctgccttccttggctgcccacatggatgcctaagtgtcttccctccgggatagagtgtcctccgtgcacatgctgaagagttgtctttcttgacgtaggccagaggcattgatgtgcagcaggtttctttagtcatcaactatgaccttcccaccaacagggaaaactatatccacaggtaagcgtagatctggaacactcccctaccccttcacacctggccctccctgggcttaaagctcctgatattcctcatccccttccttgttttccanaatcggtcgaggtggacggtttggccgtaaaggtgtggctattaacatggtgacagangaagacaagaggactcttcganacattgagaccntctacaaccctccattgaggaaatgcccctccatgttgctganctcntctgagggggtgtcctgccaccccacccccagccagggg

SEQ ID NO: 9098 - DNA, 117 bp, Homo sapiens
  misc_feature (1)...(117): n = g, a, c or t
ccttggagactcagatcctgaacaanananaacaaaatctctactttgatggaacttccattctgtggggaagagactgacaatnagcaattaaataaataagaactcagcagtagg

SEQ ID NO: 9099 - DNA, 619 bp, Homo sapiens
  misc_feature (1)...(619): n = g, a, c or t
aaaagctcagctcgaacctcacggattttcctgacaatctgcttctctcaatggccttaatttaagtgagggttgtcagtcttactgggtctcgttttttgtcttaaataataactatttatgggtatcaagtgtctcctcaatttggctatgatccttcacggcagaaatactgtcttatcttgtgatcatggagtcacaagatttcatggctaggaatattcgtcaaattaatcctagattgaggatcaggtagtatgtggtctgattctaactcaacaacttgcagaaactcacttcttttttctttttttttccccaggaggagctatcgtattaactgacgaaactcacttcatttctttggacctgcanaatgaggatgggctctaaaccacctctaaaggtaatattctatgattccatgataaggctatttgtcatttataaaaaaaggaacttccacatagcccagagaaaggaaatgactttttcaagtttacaganncaattaatggacgaaatataattgtgaaattcaatctcctgatccccagnctatnggggagttctttcaaaatggccccttgactgtccctcaaagtgccagcatgcagga

SEQ ID NO: 9100 - DNA, 431 bp, Homo sapiens
  misc_feature (1)...(431): n = g, a, c or t
aaaaagtaagccactgcctcttacctaaaggtcagcatgggcttcatcatacagcggtcaggtccatcatacagcggtcaggtccatcatacagcggtcaggtccatcatatggcggtcaggtccatcatacagcggtcaggtccatcatacggcggtcaggtccatcatacagcggncaggtccatcatacggcgctcaggtccatcatacagcggtcaggtccatcatacggtggtcaggtccatcatacggcggtcaggtccatcatacggcggtcaggtccatcatacggcgctcaggtctgtaactcttgacaggaaggtgcactagcagaatggcganatgcactgagggtaaccagatgatctcatgggacttacccagtgttagcaccaaagtcccatgaactgaggtgctaaaacataaagg

SEQ ID NO: 9101 - DNA, 533 bp, Homo sapiens
  misc_feature (1)...(533): n = g, a, c or t
aaatcttactatcaactattcttaacaggctaaaggttggtcttcaggttgtggcagtcaaggctccagggtttggtgacaatagaaagaaccagcttaaagatatggctattgctactggtggtgcagtgtttggagaagagggattgaccctgaatcttgaagacgttcagcctcatgacttaggaaaagttggagaggtcattgtgaccaaagacgatgccatgctcttaaaaggaaaaggtgacaaggctcaaattgaaaaacntattcaagaaatcattgancagttagatgtcacaactagngaatatgaaaaggaaaaactgaatgaacggcttgcaaaactttcanatggagtggcctgtgctgaaggttggtgggacaagtcgatgtttgaagtgaatganaagaaagacaganttacagatgcccttaatgctacaagagctgctgntgaagaangcattgttttgggagggggttgtgccctccttccatgtattccnnccttggactcattgactccncct

SEQ ID NO: 9102 - DNA, 519 bp, Homo sapiens
  misc_feature (1)...(519): n = g, a, c or t
ngggtctgggtacttcattattgganggagcaggtatgtggctggcattgaagggttttttggacccctgaagtactatcgccttcgcagtctgcaccccgcccagatttttaatcccctccttgagaagcaacttgctgaacaaatcaagttatattatgaaaggtgtgctgaggttcaaggaatagtatctgtgtatgcatctgcagcaaagcacgggggcgagagacaagaagcatgccacctccacaactcctacctggacctccagcgcaggtatgggagaccctcgatgtgcagagccttcccctgggagaaggagctgaaagacaaacaccccagcttgttccaggcattgctggagatggatctgctgaccgtgccaaggaaccaaaatgaatctgtatcagaaatcggngggaagatatttngagaaggctgtaaagagactctctagcattgatggncttccccaaaattanctctatcgccccnttctgacggattcccancctcggn

SEQ ID NO: 9103 - DNA, 381 bp, Homo sapiens
  misc_feature (1)...(381): n = g, a, c or t
nncatggcccaccacctgcccttcagtgttcaagcaggggacatgcaccctttagtaacctggaggggacccatcacatgacaaccaccccaatgaccatcatcaggaagccgctgcctgactgagatatgcccccaggaggacaagggagagtggatgctggaaagacagggcaggggaccatcaccagggaaagacttcattcttcggaggacattgaacctggggctgggtctgtancggagccgctgtttcttctcctgtatccaactgttctaactcttgggctttctccattttcagctctttcttttcctggccttctcattgctggttccttcaancctcctctctattcttccgacaatatatncttttttt

SEQ ID NO: 9104 - DNA, 459 bp, Homo sapiens
  misc_feature (1)...(459): n = g, a, c or t
naaaattgatcacaacgaggganaacaaaataaaattagggggcaaagggtaggagtatggggggaggggagagcaaacctatcgaatatatcttagaattttgctcagaaatcactgctgcctctcaagtgttgcattgtccctgcctaaaccaagaaggctaaacaaagcccctcctgtttgaattcttaaggtaagaaatttctaagctaagaaaacactattgcctaaaaccaatgatagtggagctcatttacaaataggcatgcctcacacacacagtccaaaggcaagacactggctttgaaattaggctcatgatgtgattcctattatatgtacctgatttttttaggccccaggtatgtggaccanagttaatgtcatgactcttcaaagatatgatgaananttnccctagaaatctagagatgcatgtttatttaattccatanttt

SEQ ID NO: 9105 - DNA, 140 bp, Homo sapiens
  misc_feature (1)...(140): n = g, a, c or t
ncttntgcgccctccctgagcaccggctcaggcaccggggtcaggctgcaggaacacatggacagggagaagtaagagtagtccactgcaacgtatgtcagcatgaagttgatggtgacgatgggggccagaacgttcac

SEQ ID NO: 9106 - DNA, 262 bp, Homo sapiens
  misc_feature (1)...(262): n = g, a, c or t
nggtcctagggcactggaagggtaggaggagcacagagaaccttccatggcccctttggttctctgcctttggatggatggatttatgctggcattgtctggagggagccgggtgtcccccaataatcacagaacaaagacaattaggtcgggggaggaataaggataaaaagagaccccaacagaccctgcctgcccttccctgccccccggctgcactgctgaaatatgaggaagagatggctccagtgtggggtgctgg

SEQ ID NO: 9107 - DNA, 343 bp, Homo sapiens
  misc_feature (1)...(343): n = g, a, c or t
gggtctgtgtttggtggcccaggtnctaatttcaagatgccaggacgttccagttcaaattcaggttcaactggtttcatctccttcagtggtgtagagtctgctctctcctccttgaaaaacttccaagcctgtatcaactctggnatggacacagcttctagtgttgctttggatcttgtggaaagtcagactgaagtgagtagtgaatatagtatggacaaggcaatggttgaatttgctacattggatcggcaactaaaccattatgtaaaggctgttcaatctacaataaatcatgtgaaagaagaacgtccanaaaaaataccngatttacctcngn

SEQ ID NO: 9108 - DNA, 608 bp, Homo sapiens
  misc_feature (1)...(608): n = g, a, c or t
nctgataacgttcacagccccatcctcagcacgtggattcgagtcaccgtgagaacccttttgtctccttcagttccggtatctcaccctgtcctcaccttcagggctcccagggcccacactgtggtgggggacctgctggagcttcactgtgagtccctgagaggctctcccccgatcctgtaccgattttatcatgaggatgtcaccctggggaacagctcagccccctctggaggaggagcctccttcaacctctctctgactgcagaacattctggaaactactcctgtgatgcagacaatggcctgggggcccagcacagtcatggagtgagtctcagggtcacagttccggtgtctcgccccgtcctcaccctcagggctcccggggcccaggctgtggtgggggacctgctggagcttcactgtgagtccctgagaggctccttcccgatcctgtactggttttatcacgaggatgacaccttggggaacatctcggcccactctggaggaggggcatccttcaaacctctctctgactacagaacattctggaaactnctcatgtgaggcttgacaatggccctgggggccccagcaca

SEQ ID NO: 9109 - DNA, 443 bp, Homo sapiens
  misc_feature (1)...(443): n = g, a, c or t
ngggtccattgcctcggccccaacnacaccaagcccatcaaggttttcattgctcagtcccgatcatctggaagccaccgagatgttgaagatgaagaacttacaanaatctttgttatgataccaaagtcctacacagaagaagatctgcgggaaaaatntaaggngtatggagatatcgagnattgcaccattattaanaataaagtgactggagaaagtaaaggnttgggctacgtacgatacttaaaaccatcacaagctgnccaagcaatagaaaactgngatcgaagctttaganccaatcttggctgaacctnaaantaaagcntctgaatcctctgaacaagattattatagnantatgaggcangaagctctgggacatgaaccctanaataaatatgtntncatttggcaagnngcgccacctttactttnaa

SEQ ID NO: 9110 - DNA, 541 bp, Homo sapiens
  misc_feature (1)...(541): n = g, a, c or t
nagaaagtggttgtgatcacaaagcacaacgatgatgaacagtatgcttgggagtcttctgctggaggttccttcactgtgcgtgctgaccatggtgagcccattggcaggggtaccaaagtgatcctccatcttaaagaagatcagacagagtacctagaagagaggcgggtcaaagaagtagtgaagaagcattctcagttcataggctatcccatcaccctttatttggagaaggaacgagagaaggaaattantgatgatgaggcagaggaagagaaaggtgagaaagaagaggaagataaagatgatgaagaaaagcccaagatcgaagatgtgggttcagatgaggaggatgacagccggtaaggataacgaanaacanaactannaagatcaaagagaaatacattgatcaggaagaactnaacangaccaagcctatttggaccagaaaccctgatgacatcccccaanacgagtattggagaattctacanganccctcncntaatgactggggaanaccacttggcagtca

SEQ ID NO: 9111 - DNA, 264 bp, Homo sapiens
ggaacatactgagttaacacattttcctagtagtgatagaattttcagggaagcaagaaaccaagaaaattctggctgctacctaattttaatgaagttggcgattatctgcccacaaggtatgagaagtatagatgtgcattgctctacaaatatacaacgcaataaggcccactcgaaattcatgaaaggcttgccaagccacatggcttgattggtcgtaggtagatgcatgatgtccctcttagaatgaggcccatgttt

SEQ ID NO: 9112 - DNA, 333 bp, Homo sapiens
  misc_feature (1)...(333): n = g, a, c or t
ncctgcttcacttgcagataagtttattataattctccagaaatgtgcaggatgtgcattagcaaattgcactgtacttttcactccagcctgggtgacagagcaagactcccgtctcgggggcttaaaaaaaaaaatgctgtatctaaatgaatctgtgtaattgggcccanatgtgggtttgctcagtattagtagacaaggtctttgttcanacgattaggtgcctaactggcaaatgccttagtttcttaaaacgtattttctgatgnggctttacatttcaaaagtgaacttgattcaacctganaaaactgattaaaaaattagttt

SEQ ID NO: 9113 - DNA, 380 bp, Homo sapiens
  misc_feature (1)...(380): n = g, a, c or t
naaatcanacgtgtaggtttgctttgtattgccctgcatgacacatgtcaggaagatcgccagggaggggaggttacaagcccaggttgcaggaataacctttactctgaattttggtctgaaagacttttccttcgtctggagctgggctggccttgtgatattgtgccacagcagacacgacactgtctccaaggcggagctcattgcctggggctttcccactgcactgaatgagaatttatttggcctttaatgaaattcagattgtcccatttatgcagncctctgtttaangtgacaggcactgaatatggttgctttcaancaagttattttgtttaaccaggggcctancggagttcgggatacacagatgg

SEQ ID NO: 9114 - DNA, 623 bp, Homo sapiens
  misc_feature (1)...(623): n = g, a, c or t
ctgaanaagggaagggcagtgatggggttatggaggaagtatggcagggaaagcaggagggtgatgctggaagacaaatggtagatcccaggcggactggaaagaattgcaatagggggagccggggagtgcagtctgtgagaggctggaaatgtgaaagccaggagctctcagggatttgggttgcctcctgcacagtcaaggagagtgtcactcaggctagtcatagatggcatacctacaggcttgggctgattttagatagttgttcagagcagtcaggcaggcgccagaggcacaagccctgtgagaggtgtgtttggaatcacttggtatccaaatcacatgtcatccctaggagcaaggagaccggttggatttggggctggtctggaatgaagaagcatctctcagcttccgaaggctgcatggctcacggcagtatctcaatcatgccctgcccgtttgcacatttggtcctgttggnagttacctctctggtgactggcaaagtcngcaaggatattggggtggagcaccctggctaagcaccctcttgattatagagctatggagtacaanacagatggagaatgagaggacctgccccgggcgggcccnct

SEQ ID NO: 9115 - DNA, 311 bp, Homo sapiens
  misc_feature (1)...(311): n = g, a, c or t
nggtctgggtcagtgctgctctctaaatctttaagttttgttcttctgtactcgctttccctattttcattgctttagttctgcccttcatcatcttgcctgaattagtataaattttctaacaggtctctctgcctccagtatcatacctctctaatcttaagtataaatgtgattatctttttcctgtttgaaatccttcaattacagttncagacacanatctcttcatgatttatcacctgtttacctcttcagacatagcaactttttttttttgganacagagtctcattctattgcccaggtta

SEQ ID NO: 9116 - DNA, 511 bp, Homo sapiens
  misc_feature (1)...(511): n = g, a, c or t
ccagcggaaagttttatttacctgtttcaagaggaatgataaacgtgaagtaaaagttgcccagttggctggctctgttgctgagatgtcggcttatcatcatggagaacaagcattgatgatgactattgtgaatttggctcagaactttgtgggaagtaacaacattaacttgcttcagcctattggtcagtttggaactcggcttcatggtggcaaagatgctgcaagccctcgttatattttcacaatgttaagcactttagcaaggctactttttcctgctgtggatgacaacctccttaagttcctttatgatgataatcaacgtgtagagcctgagtggtatattcctataattcccatggntttaataaatggtgctgagggcattggtactggatgggcttgtaaactacccaactatgatgctagggaaattgtgaacaatgtcagacgaatgctagatggcctggatcctcatcccatgcttccaaactacaaaaacttt

SEQ ID NO: 9117 - DNA, 617 bp, Homo sapiens
  misc_feature (1)...(617): n = g, a, c or t
ngncttgcctcanatccaaggtcactcggaagaggccatgtctaccctcaatgacactcatggaggaaatgctgagagaagcattcagatgcatgacacaaggtaagactgccaaaaatcttgttcttgctctcctcattttgttatttgttttatttttaggagttttgagagcaaaatgacaacacccagaaattcagtaaatgggactttcccggcagagccaatgaaaggccctattgctatgcaatctggtccaaaaccactcttcaggaggatgtcttcactggtgggccccacgcaaagcttcttcatgagggaatctaagactttgggggctgtccagattatgaatgggctcttccacattgccctggggggtcttctgatgatcccagcagggatctatgcacccatctgtgtgactgtgtggtaccctctctggggaggcattatgtatattatttccggatcactcctggcaccaacggagaaaaactccaggaagtgtttggtcaaaggaaaaatgataatgaattcattgancctctttgctgcatttctggaatgattctttcaatcatggacatacttaatattaaaatttcccatttttt

SEQ ID NO: 9118 - DNA, 214 bp, Homo sapiens
  misc_feature (1)...(214): n = g, a, c or t
nggtctgaataggcacccaaaagtccgtgactaaatttcgtttgtctttttgatagcaaattatgttaagagacagtgatggctagggctcaacaattttgtattcccatgtttgtgtgagacagagtttgttttcccttgaacttggttagaattgtgctactgtgaacgctgatcctgcatatggaagtcccacttcggtgacatttcctgg

SEQ ID NO: 9119 - DNA, 357 bp, Homo sapiens
ccacactgtgaaccctcccagagactttagacagagagaggggctccacaacaccccggtattctgtctgccctctctcacccccttccctgtccacacaggtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccagcagctacctgagcccgacgcccgagcagtggaagtcccacagaagctacag

SEQ ID NO: 9120 - DNA, 457 bp, Homo sapiens
  misc_feature (1)...(457): n = g, a, c or t
ctgncttancaagcaccctangagcatgaatatacaaagaccacaagcttacacatctttttaacatacacaaccgattttacttacctagccaaggcatattcttcctgtgcggtacctccacctacctctgctaccctatcaactggactggtacctgtactctggtttttctaagcccaaaaatcgacattgtcccaggagaacaaaacctacctatccctgtaaaaactcaagtgtgccaatgcagggccgttcagttaatacccatcctagtacgactaggaatgactactgcagttggaaccggagtggtcgggctttctacttccctcatgtactattgctccctctcacaagatcttacaaacagtttggaagacttacctaatactgtttcaaccctccaatcacagatagactccttagcagcagttgtccttcaaaatcgcagagg

SEQ ID NO: 9121 - DNA, 241 bp, Homo sapiens
aaatgacccgtaactaaatcctagatttttatctagtcagtttctttttttccaagtcctatctttcacagttgtgcttctgggatttactcacagccatactaactgggagtcaagaaaagggataaggggaataacggggcttagtaagctctggaattactggatgaacacatcttatgagatgaaacaatgacaggaacgctaccaaggcagcagtgtcaccgcatttgacgttttt

SEQ ID NO: 9122 - DNA, 347 bp, Homo sapiens
  misc_feature (1)...(347): n = g, a, c or t
nggtccgccgcggactccggcagctttatcgccagannccctgaactctcgctttctttttaatcccctgcatcggatcaccggcgtgccccaccatgtcagacgcagccgtagacaccagctccgaaatcaccaccaaggacttaaaggagaagaaggaagntgtggaagangcagaaaatggaagagacgcccctgctaacgggaatgctaatgaggaaaatggggagcaagaggcngacnangaggtagacgaanaagaggaagaaggtggggaggaagaggaggaggaagaatanggtgatggtgaggaagaggatggagatgaagatgaggaagctgagtcn

SEQ ID NO: 9123 - DNA, 204 bp, Homo sapiens
ctggtcctccagccgcctcagctccttcacagagctctcctggaaggactcctgggtcatgctggtcccagagagagaagagtaagcctcggatctctttggtgggaggtaaggccacaccaaagatgaaagaggaccccctagtgggctcccgtcaggagagcgggtgcccagcactcattgtgaacctgagaaggggcaagg

SEQ ID NO: 9124 - DNA, 356 bp, Homo sapiens
  misc_feature (1)...(356): n = g, a, c or t
gcctggtaggttaaggaacagannacattttgagagacgcttggngccaatgaagtggctgaagaaatgtctggatacaggttttccaatttaccatttgtgtctggggatagngggaggcagncccatctatggcttggggaggctgtagccattcctcctctttcccttgtaagagtgagaaacccatccatggccttctctantcaatacagnggcctggnntgaattanacaaaggaatcccctttgggaggatacancccctatgccaggatgtatggcatggtgancagantgcaccgctttcacttgnttctttggctaggagtgtttgcgcagtnccccaaccacacn

SEQ ID NO: 9125 - DNA, 622 bp, Homo sapiens
  misc_feature (1)...(622): n = g, a, c or t
ctggcagctcacattttacattagagagtggggtccccacattttacattacagagcggggtccctgagctgcaggaggagagcctgcagggctcttgggtagaattgcacttttgcaataagggaaacgggagcaatgtttcagcctcagtttctatttataatactgacacaaaaagaatattgctggatacatagcatggatctagatagagcagctccaggagttctcacggtgacagcccccctcactcacagacaccatgtgatattaatagggcttagacacaaagcactgaattcccaaagcattgaagagaaagacagctctcagtctgagtaaaaccgtattgagagaagaaaagaggttgaaagaatcttanagacaaattcagattacntgtaacattggtcaaattgaccagaaaatattcttccaaagaagttcttntctaaacaccaaaagtgcacagctactctcagcatgagaaatacaagtattatgagaaagagggcttattctgagcagaatttncntctctgctgctctcccatctgcccggcccgntgggatttggggaaatctatacttggaacacacctgacaacctccnccngactt

SEQ ID NO: 9126 - DNA, 144 bp, Homo sapiens
  misc_feature (1)...(144): n = g, a, c or t
aaagngagcagcgccaanttccttaaagataagcttgggnanataggagcacacnaanatgagntcanctttgaacagntccatctcttctataaaaaacttatgttttgancagcananatcgatnctcgatgaattcaaaaa

SEQ ID NO: 9127 - DNA, 657 bp, Homo sapiens
  misc_feature (1)...(657): n = g, a, c or t
nggtaaaattgttttgtattttcttattcctgttccctttaccctttgacaacttgaaatgttaccacttcgtcctcatgatgttcttctatcaaccctgcttaggatgagaacaagttgagcagtgccaacggccatgaagaacgtagcaaaaaacaaactttctgcctccttggaaagctctacatctccttgtgattggagtgtgggtttcaagattccagaaggaggaaaaaaagcaagagcagaagtcgtagtcatgaacgaaagagaagcaaaagtaaggaacggaagcgaagtagagacagagaaaggaaaaagagcaaaagccgtgaaagaaagcgaagtagaagcaaagagaggcgacggagccgctcaagaagtcgagatcgaagatttagaggccgntacagaagtccttactccggaccaaaatttaacagtgccatccgaggaaagattgggttgcctcatagcatcaaattaagcagacgacgttcccgaagcaaaagtccattcanaaaagacangagccctgtgagagaacctattgataatttaactcctgaggaaaagagatgcaaggacagtcttctgtatgcagacctcggccgcgaccccgctaanggcggaattcccancaccctgggcggcccg

SEQ ID NO: 9128 - DNA, 292 bp, Homo sapiens
  misc_feature (1)...(292): n = g, a, c or t
naaatttgaaaagcatcatgttctcatgatttatgggaatgaagcaagtactgaaatcaaattaaatactccctgggtcctgggtcagnttgaccctagccctggggtgaggcaagccccctcctatgaggatgagcaaaaatactactctcttcgccctgagttgctttctggatctggggcttcaggacttgctgnttcantcagcctttattancaccnaagactttatgaagatcccacacacagacacacatcccttncccgcctcccccctgcccttnngtagnat

SEQ ID NO: 9129 - DNA, 113 bp, Homo sapiens
  misc_feature (1)...(113): n = g, a, c or t
anataagctgctatcagaagagntatcacttcgatttgcaagttccacagcatcagatgtcacatggtcaagagaatctattcctgatttatccatcaattgctctttgtttt

SEQ ID NO: 9130 - DNA, 431 bp, Homo sapiens
  misc_feature (1)...(431): n = g, a, c or t
cngatgccccaggaggccggcctggcggaggagttcctgctcactgacaatagtgccatatggcaaacggtanaagaactggattacttacaagtggaggctgaggccaagatggagaacttgcgagctgcagtgccaggtcaacccctanctntggtgctggancanggcctgatataggngngtggccctnacagactgcccgtggtggccccaaggacacccagcccagctatcaccatggcaatggaccttacaacnaccnggacatccctggctgctggtttttcaagctgcctcacaaggatggtaatacctgnaatgtgggaagcccctttgccaangacttccctgcccaaaatggangatggcaccctgnangctggcccaggangtgncagtgngccccgngctctggcaaatcaacanaa

SEQ ID NO: 9131 - DNA, 317 bp, Homo sapiens
  misc_feature (1)...(317): n = g, a, c or t
accttttccatgtatgaacctggctctgccctgaagccctttgggggcccccctggggacnagctcactacgcggctgcagcctttccacagcactgagctagaggacgacgccatctattcagtgcacgtccctgctggcctttaccgggnaagcctnggggaancgtgtncatcttaaccagtaggttctgagccccagggggttntggnctctgcgctgaattcggggcttaagatgattagactgaccttggtccctgctgcactgctggtgagcaggggggcagtggggcacactgactccatccancgctg

SEQ ID NO: 9132 - DNA, 224 bp, Homo sapiens
aaacaatgaaactttttcaaaaagaaaaaacaaaaactttaactttgtgtaaaatcttatagtattatcagcttagagggaattgatatttttaatattgccgttatattccaaaatatatattgagataaatgaactggtgtagaatatcagtttgctatttagttttatgaattactatacatatacatgcatagaaatgaaatgctatactgataaatttt

SEQ ID NO: 9133 - DNA, 486 bp, Homo sapiens
  misc_feature (1)...(486): n = g, a, c or t
cctgttctgttcctggaagttcctgtaacattgagtgtcaccactttactgtgctgggcccccaggccattgtcagcctcacatgagtagtttccagaatgttctgtagtcagagagaggttgaaggatgcccctcctccagagtgggccgagatgttncccaaggtgtcatcctcgtgataaaaccagtacaggatcgggaaggagcctctcagggactcacagtgaagctncagcaggtcccccaccacanctgggccccgggagccctgacggtgaggacggggcgagacaccngaactgtgaccctgagactcactccatgactgtgctgggcccccaggccattntctgcatnacaggagtagtttccagaatgttctgcagtcataatagaggttgaaggacgctctcctccnnaggggggctgagctgtttccccnngggtgacatccttcatgatanaaatnggnacagggattcggg

SEQ ID NO: 9134 - DNA, 150 bp, Homo sapiens
  misc_feature (1)...(150): n = g, a, c or t
ttcacaantnccctagcatcatagttgggtagtgttacaagcccatccagtaccaatgccctcagcaccatttattaaaaccatgggaattataggaatataccactcaggctctacacgttgattatcatcataaaggaacttanngga

SEQ ID NO: 9135 - DNA, 229 bp, Homo sapiens
  misc_feature (1)...(229): n = g, a, c or t
ctgcgattttgaaggacaactgctgctaaggagtctatctgtgattggagggttgaaacagtattaggtaagtcttccaaactgtttgtaagatcttgtgagagggagcaatactacatgagggaagtagaaagcccgaccactccggttccaactgcagtagtcattcctaggcgtactacgatgggnattaactgaacggccctgcattggcacacttgagttttta

SEQ ID NO: 9136 - DNA, 204 bp, Homo sapiens
  misc_feature (1)...(204): n = g, a, c or t
nnttgccccttctcaggttcacaatgagtgctgggcacccgctctcctgacgggagcccactagggggtcctctttcatctttggtgtggncttacctcccaccaaagagatccgaggcttactcttctctctntgggaccagcatgacccangagnccttccatgagagctctgtgaaggagctgaggcggctggaggaccat

SEQ ID NO: 9137 - DNA, 199 bp, Homo sapiens
  misc_feature (1)...(199): n = g, a, c or t
taccataagaaaaacacaacagttttaggnngntgataaattaattcctctctgntgtaaacctaaaactaaacaaaaacaaaaatacccagagcagatggggagagggtgggaggcggaacacacactcatacacacacacacactcacgcacacacacaancagtncacgttaagctctgcatncccactatanggg

SEQ ID NO: 9138 - DNA, 113 bp, Homo sapiens
  misc_feature (1)...(113): n = g, a, c or t
ttnacaaagagcaattgatggataaatcangaatagattctcttgaccatgtgacatctgatgctgtggaacttgcaaatcgaagtgataactcttctgatagcagcttattt

SEQ ID NO: 9139 - DNA, 235 bp, Homo sapiens
  misc_feature (1)...(235): n = g, a, c or t
acaaaagtgtttggagtttgtacttattcctgcnttgaactttatttcttgtctttctattcttacttaagctgtngttatagaaaaccggagcttgagtttctgaaaaagactgatgggctacttctttatagataaaaaggggttcataaattagtgcaaatatnttaggaccttttcagcacttggcgtaggatggaagaggtaagaggtaagaanatactctgtngaagtt

SEQ ID NO: 9140 - DNA, 249 bp, Homo sapiens
  misc_feature (1)...(249): n = g, a, c or t
aggccaggaaatcaaagagaagatggaacgctgcgacaaagaaggtcagcgccaggaagtataagttggtatctacaaaaattcctttcacctcatcagcatctttctctgaaaacccgaactgctgcagggagtacacggcgtcctgcatgtggatccanaagcgcagccgccccagggagaccttgtcgtaggacacggtgaggggcagctcggtggtggnaagcggattatgaccatcaggnccct

SEQ ID NO: 9141 - DNA, 237 bp, Homo sapiens
  misc_feature (1)...(237): n = g, a, c or t
caaaatctttataaactgtgtctganaaagtgcacacgtgtgtgtgacatgctcaaaggtcanacaaggggtggncaggaagggatgtattttacaagccacttgtatctttttccaaaaacacctacccatgttnggggaatgttaaacaaaatcaaaanacaaccttttgtagccgttggaagcntcatgtnctttcttctaacttggcttcnccagcggaagngaccgtggtgg

SEQ ID NO: 9142 - DNA, 247 bp, Homo sapiens
  misc_feature (1)...(247): n = g, a, c or t
nttatatattcatctataatagcaaagacaanagtgtatcttccagaagatgcctctggttgctaaccagtctctgtgaagaagctgcagttacccaggcttctgtaactcaggacattgaagtagtcatgcagctcggcacagtcccctccccgctgctctccacagagcccagcaggtgcagcttctgcctggacacagcttcctgggggtgagggagcactggggctccattcctcctgtccag

SEQ ID NO: 9143 - DNA, 214 bp, Homo sapiens
  misc_feature (1)...(214): n = g, a, c or t
tttctcaggttgaancaagttcacttttgaaatgtaaagccacatcagaaaatacgttttaagaaactaaggcatttgccagntaggcacctaatcgtctgaacaaagaccttgtctactaatactgagcaaacccacatctgggcccaattacacagattcatttagatacagcatttttttttttttaagcccccgagacgggagnnttgct

SEQ ID NO: 9144 - DNA, 217 bp, Homo sapiens
  misc_feature (1)...(217): n = g, a, c or t
tgtntnaaatcatagaatctgctcgaagaaganaatnaggacctgctatccactgggagaggctatcagccantcctgggacttggagacccagcatcctttgcattactttttccttcaggatgatctanagcagcatggagctgttggtanaatattagttnttaaccatacattgtcccaaaagngtctgtgcatngtgcaaaanggaaactta

SEQ ID NO: 9145 - DNA, 254 bp, Homo sapiens
  misc_feature (1)...(254): n = g, a, c or t
ccaaataatgggggagaactgtcagtgcccacacccatttctcagtggtcagtttcagccgctgttgactgaagacaaacgaactcactatgttcttcacaaagatcattttttttaantaagaaaaatgtttcaactctcttgcctttccttcagcgaatgaaatgtgacgggctaaatacgccagtcactcatgcgccgnagggacacatggtgcatactgnngngcccaggtngcaaacagaatncccaag

SEQ ID NO: 9146 - DNA, 166 bp, Homo sapiens
  misc_feature (1)...(166): n = g, a, c or t
attgtgggtccaccacnccanctttgcttcattttacttctgctgcctctnctttctnttgctaccctgtgctgcatgangaatntannataatttgtaacaccctgggattccttaaagaaaacananaaggactagactcccctttnngggagcaactctctgt

SEQ ID NO: 9147 - DNA, 243 bp, Homo sapiens
  misc_feature (1)...(243): n = g, a, c or t
ccacttgtgtgggtcctcacaagcaaagagagcnctaaacttgacattgggggtccaccactccaactttgctttctgaaggttttggtgtacattgagccccagaaggaaaggagagtatntgtgagtgggggcctcccttgaccccagtacgaagtctatgccctgaatccccagagnagnccctcctggtgcccaactggcctggggacnaacagcggnncactacatntaggactgcnt

SEQ ID NO: 9148 - DNA, 109 bp, Homo sapiens
  misc_feature (1)...(109): n = g, a, c or t
tcaccctgaccatcaacagggtcgaagccggggatgaggccaactattactgtcaagtgtgggatccgtaataatgaccatgtcgtcttcngnggagggaccaaactgg

SEQ ID NO: 9149 - DNA, 510 bp, Homo sapiens
  misc_feature (1)...(510): n = g, a, c or t
ctgaggacaaacatgagatgagcatagtcagggacagatgtttgggagaaacaaaaggagggtaagtaggaagcgcagggcaaaggcaggcagagcgagtattgcagcagcctttgctgcgtgctgggaagtttctaacaatgcagggctcttggaaagcactgagattgcagcacttgttttgatagcgaggcaaggagtcacaaagtcaggcaaggagggtcatggaaagcggggtgacagagggagaagtccggggcggtggctctcctctaaagcctgtacctagtcctcatctctctccagcctctttacaatgttcatccatggaaagtgaagcccagagaagttaagtaacttgcttaaggtcacacagcagcgttgacaaaaacaaacatacacaaaaaaataaatcacggccaggcacggtggctcacgcctgtaatcccaacattttggaaggctgacgcangaagatcanctgaggtcaggaggtggacaccngcatgg

SEQ ID NO: 9150 - DNA, 293 bp, Homo sapiens
  misc_feature (1)...(293): n = g, a, c or t
nggtaaatttgagtaatttcaaattccacaaacaaaactgaagaacagcaatatttngtttgaatttctctcttctgtacactcagtgatctaaaacaccacaatatccaacatacacaaacctnagggaagggttagtaaacacacacaagatnggaatcatggtgctctttgttcctgaatggaatggtcccacagaaaaagcacaggatacagcacancatangggcacctgttacatangaantgagcaaaacatactancatcttctatntncatnatggggaaacct

SEQ ID NO: 9151 - DNA, 96 bp, Homo sapiens
  misc_feature (1)...(96): n = g, a, c or t
ngncntgaggaagctcttcattggagggttgagctttgaaacaactgatgagagcctgangagccattttgagcactggggaacgctcncggactg

SEQ ID NO: 9152 - DNA, 263 bp, Homo sapiens
  misc_feature (1)...(263): n = g, a, c or t
nggtctgtgaaaaaagccatttccnaagattctggctgtgactcagtcactgacactgagcctgaggacgagaaggttgtttcctactngaagcancagaacctgccgacggtgacttcacctgggaacctgatggtggtgcagcccggaccgcattcgctgngggncaaaaaccactggctatnttattgtganatgtaagctgnatgacagggtggcgacncgaacgacagttttctcctgaggattntccctntgcaagg

SEQ ID NO: 9153 - DNA, 292 bp, Homo sapiens
  misc_feature (1)...(292): n = g, a, c or t
ccatgtccccagaattgaagccagagaatcgctcagatatccctgagggccggtcgttatcaaaaaagatgattaggacaggggcctggcctggcttctggtaataccagtgtacattgttactcccaatattgtttcccccacaggtaatcttggccgtctttcctggggccactgacactgagggtgtctgagtcaacacataggaggtcacagagtctgtgcagtgagagaggaggccgaggaggagaacggnccaggccatggctgaggcaccaccagtgctgcttcc

SEQ ID NO: 9154 - DNA, 306 bp, Homo sapiens
  misc_feature (1)...(306): n = g, a, c or t
gaaaaaataggacctattttttaagactttacagcctttgaaatggtttccacgtgattgttacnccagcagttctcgttttgtttgtttttcaatctcagtgaaatggctctttgctttcgagttctcacgcaacgtactgggcaaatgacaatcctcanccgctgntattttctaaggggtctcttcactttgatgagtgacatgaacaccgngtctccttctcttgngngtaccctaanccatatttccaancctgtggtactccaggattccangagtaagcctgtanaagagatttatttt

SEQ ID NO: 9155 - DNA, 510 bp, Homo sapiens
  misc_feature (1)...(510): n = g, a, c or t
cctactagacccctcttattaacctggggcaaacccatttggtaaaagatgactattgagtcttacccctacctgctccaggttagtacacaccaggcaacaggtggcattctaccctacccctttctggaggtggttctggacacctcaaaacctttgacatttgaattaacacgctaagacatctgcaaatgaacaatcagacaaagcattgctgggagttgggaattttggaaactctgttcacttaccaccaaatttattgaagccaccacggtcacttccgctggagaagacaagttagaagaaaggacatgaagcttccaacggctacaaaaggttgttttttgattttgtttaacattccccaaacatgggtaggtgtttttggaaaaagatacaagtggctactaaaanacatcccttcctgaccaccccttgtctgacctttgagcatgtcacacacacgtgtgcaatttctcannacncagtttataaanattttgcttt

SEQ ID NO: 9156 - DNA, 191 bp, Homo sapiens
  misc_feature (1)...(191): n = g, a, c or t
nggtctgaatcttcggtgattttctcgatgtcgctgttcttgcaggtcttctgcatggcctcctgcttgctgctttcaccattgctggtggatggcatctcatcactggcccatttagagaactcaggtgtgatgccgcgtgctgggagggccgccactggaggaaaggagggaggaaaaacaaagtgagg

SEQ ID NO: 9157 - DNA, 291 bp, Homo sapiens
  misc_feature (1)...(291): n = g, a, c or t
nggtaaaacaggagtgaagagagcagaaatctccaatgccatcgatcaatatgtgactggaaccattggcgaggatgaagatttgataaagnggaaggcactgtttgaggaagtccctgagttactcactgaggcagagaagaaggaatgggttgagaaactgactgaagtttctatcagctctgatgctttcttccctttccgagataacgtagacagagctaaaaggagtggcgtggccgtacattgcggctccctccggntctgctgctgacaaagttgtgattgagg

SEQ ID NO: 9158 - DNA, 643 bp, Homo sapiens
  misc_feature (1)...(643): n = g, a, c or t
aaatgatgccttgacttttgaattcaattctagaaccaattatcctaaactaaatcagagtattacaaatgaagatattccaacacaaagacttgtaggattttgtttagattgtcaatggttgattcatccaaattttcttcattgtcatccatggtgtgccagacttcagggaaaggagacggtatcagatgcagaactggaacacctcttcttaaaaatggaatatggtcatcctgaatcacacctccataactgtaattctggaaataccgcccctccaaagagtgatccttgagcaaacccaattcatgaagttcatgttcaattgcttgaagtctttcgaaccacctggctgagtttggaaaaaaantgggaaacgttgggtttggagctccaatcaaatccaataagaccaataaatccatgccatgcanttggctggtgcctctcgctccaggtgggtgcggggtcnatgccntctttcagctaagtgccagacccatagaggagaatcttgnncgagaccagngaacaaaagcctcttcnccctcaaagaagatcnacctggngtgaccaaatctggcttgggantctgaaacacgncctttaaggaanggaantttctttgtctaaggcacng

SEQ ID NO: 9159 - DNA, 318 bp, Homo sapiens
  misc_feature (1)...(318): n = g, a, c or t
gggnntgttctgggatagaaggcncnctgcannccaaaagggcaggaaggttncaatcctangncactgggacctttnctttctttntttcccaaaactccnggctggaacaaggaacttaaagttctcttttgccttgatggcttctcacanacatcttaaancacctgatgaaggatatgaanaganactacganatttagaaangaccnaggtcctctgataatatganccagttgtnangtaccttcagctgncgggcattccctctccacaggaacaggnggtntgatacaagggcaccacacggaggacctc

SEQ ID NO: 9160 - DNA, 591 bp, Homo sapiens
  misc_feature (1)...(591): n = g, a, c or t
naaagtancaggtttaggttttgctacattctcaaaagacagcaggagtatttgacacatctgtgatggagtatacaacaatgcattttaagagcaaatgcaacaaaacaaatctggactatggataaataatttgagagctgccacccacaaatataaatacagtactcatgctgactgaaataataagacatctacaaatttataaacaaaaagtgattgtcattatcctgcttatgtactagattcaggcaagcattatagactttttggttgcggtggcttttgcatttatattatcaatgccttgcaggaacgttgcattgataggcccattttatttttttattttttttttcgagacaggatctcactctgtagcacaggctggattgcagtgcaatcctgcaattctcaatcttgcactgcagcctcgacctcccaggctccagtgactctcccacctcagcctcctaagtagctgggagtacaggccgcaccaccacgcctagctgatttttgtattttttttgnanagacggggggtttgggacctgccccgggcgggccaaggggcgaaattcccagcac

SEQ ID NO: 9161 - DNA, 161 bp, Homo sapiens
ctacctgcgctggccgaatctctgcttttaggagctcactcctcataggtagagttgacaataagcacacaaacaagtgagatagcagggcagccggaccacccagttgggcaattcgtggcttggcctaggaacgttacatttgactgaggctggcgagg

SEQ ID NO: 9162 - DNA, 587 bp, Homo sapiens
  misc_feature (1)...(587): n = g, a, c or t
nctgcaaataatcagaagccaaggccaggccatcgatttgacactgcaggcagatgaggtcttgggatgcctcttgcgttcccccttctgtgggagcaggtgccttcccaacctcagcactcagtcccaatctctcttccactctcctgggttcaaacaggaacctctctgttggcacgaagcttttgaggggagcaggtctaacaagaaggaaaaaggggggttattagcacggaagccccaccctgccaccaggttggctggggacagggaccaatccaccaggctcgggaggcttggggtggggcagggaagtcttcctccatccctcaaatttagggaaccactgggagccccagactcaggctgaaaatgtctttctgcaaatataaaactctttttaatgaatttgcctaatttctcagagaccctgggctggagaaccagtgcaatgtcacacgggagaggaaggactgtcctgtttattgggagggangagggggatgctggtgcancctgctcaggagtcacccagggtctgagggctgacttgcagctctgggccagaccttgcccggggcggccgg

SEQ ID NO: 9163 - DNA, 578 bp, Homo sapiens
  misc_feature (1)...(578): n = g, a, c or t
ctggtggttaacaagtggatcgtcatgttcagtagtttatacattatgtgagaagtaacgttctgattctttttcttacacagaattggcagagggggtcgatttgggaggaaaggtgtggctataaactttgttactgaagaagacaagaggattcctcgtgacattgagactttctacaatactacagtggaggagatgcccatgaatgtggctgaccttatttaattcctgggatgagagttttggatgcagtgctcgctgttgctgaataggcgatcacaacgtgcattgtgcttctttctttgggaatatttgaatcttgtctcaatgctcataacggatcagaaatacagattttgatagcagagcgacgttagtcgtgagctcttgtgaggaaagtcattggctttatcctctttanagttagactgttggggtgggnataaaagatggggtctgtaaaatctttctttcttagaaatttatttcctagttctgtacaaatggttgtattagatgtctctatcatttaataatatacttgtgggactaaaagatataagtgcctgtataaa

SEQ ID NO: 9164 - DNA, 344 bp, Homo sapiens
aaaggagtgcttatttgcctaaatggctgttgacatacttaatagttttgtatctgattctagtatgctaaagcatttcagtattatgagaatacaatttacacactggatccccttgtacttattctttcagttgtcaaaatgttaccattattgctgggattctaagaaatctctacaaatgcctctgatgacatcagaaacaattggttctaatcctgtgaactctcttgtgaagaaagcatgagactccttcggtttagaagccatatctttcaggtcatccagaggtgcccaagccacaccaacagagaagatagtgattcctgcatcatgtgcagcag

SEQ ID NO: 9165 - DNA, 352 bp, Homo sapiens
  misc_feature (1)...(352): n = g, a, c or t
ncctggcaccaggctgcctgtctttggttttacttccttgtcactttttcttaaaagaggtactgagtataaaacaatataaaacaatatgagagggtctctctctcttccctcatttcccccctttgagactctcagtttttattaggtgggagttctgagtcttatttttgctacttatgtctttttgtgcaatagattgatagtgatgtatatagtatgcttctgctaaagcattttggtgaactaaggtcgngacaaagttttttatcatttggagaaatacaggtatcagacaaaggagcagtaagcaggtttctattactattattactcttattataagagtttt

SEQ ID NO: 9166 - DNA, 511 bp, Homo sapiens
  misc_feature (1)...(511): n = g, a, c or t
nnaaatcccagtttcagggaacaggactcaggtgggagccacgcctaaaagccttccacagagagagtgtggttaagcgcataggcgtcgctatcctcttcctccaaaagcagcttgtcgatggtcaacgagctggcggctcttctggggtcttccatgtcctgaaggactggctctgggatagagatggggagctggacaaactggggcccangtagggctggggccggaggctggtactgcagggtggaggtgggtagtgtggaaaggggctgaggccacnggaaataggtgaggggtgcccggtgctctgggccctccagcgggggccccactgcgggcgtggcggaccttcttgtctgtgacaggaaaacaccgtgacagagggttagcanccccaggagacccatccacccntccttgcccttagagggggcctccatctcccccttcaattntgcccttttctggtttctcacttcatggggcttcacctcctcctgnttaaaag

SEQ ID NO: 9167 - DNA, 371 bp, Homo sapiens
  misc_feature (1)...(371): n = g, a, c or t
aaggaccncgggaaggatatggaggcttcaggggacagngggaaggcagcncaggcttcaggggacagcgggacggaaacagaagattcagaggacagcgggaaggcaccagaggcccgagaggacagcgatcangaggtggcaacaaaagtaacagatcccaaaacaaaggccanaagcggagtttcagnaaagcatttggncaatanntagaaatagaagatttatatagcaaaaagagaatgatgttnggnaatatagaactgaacattatttttcatgcaaagntaaaagcacattgngcctccttttgaccacttgccaagtccctgnctctttcanacacanacaagcttcatttacctcngccg

SEQ ID NO: 9168 - DNA, 425 bp, Homo sapiens
  misc_feature (1)...(425): n = g, a, c or t
naaacttctgtttgccagctctgtcttcagtaccaggcacttccttgggacttccttctttgtatgggggcctgataagccactccagacaaggggctgttctttatgacttgggaggaatcagcaattctanaaggagtcattgcctttggtgctttagtttgttctattacttcttttctaggacagagccacatattcagggaatctttatgcttctcagactcaggtttgggttccacaggcatcccatttttatcctttccttctttcttcagaagccacttatacagagcctccttctcacaattctcatcacacacacactctgcaaagcttgtgcagggctcattggctctgcacacctcctctaccttacatgggtcctgatggttctggacaagccaatcctctgtaacacctgc

SEQ ID NO: 9169 - DNA, 330 bp, Homo sapiens
aaaagaggtatgagggctgggcgtggtggcttatgtttgtaatcccagctacttgggaggctgaggttgcagccaagattgcgccactgcactacagcctgggcgacagagcaagactctcaaaaggaggcatgaaatgcacctcaatcttttgccccaagtctgccaaagattgtcaaaccctccctgttaaaaaaaaaatcaagtttacctactctcccttctatataaaggaccctaaaattaaaatgtcaatgcccaaaatgccgaagtgcagatcgtcttctctccaaataagagttacttggaatccttaacaaatccaaggga

SEQ ID NO: 9170 - DNA, 397 bp, Homo sapiens
  misc_feature (1)...(397): n = g, a, c or t
nnaatgatgtgaaagcattngttccattcaaaggcccctatgcctttgaatgacatattctcagtaacttctttgccagtaactagagtatgtgagactgagtaactataatgtgcatatttcaagaattagcttcccgctgcattataacacatttcctaggaaagcctttgtatttttcatagccttttcacatatccctcatttaagaagtcacagtgttgcagttttactttgtttcagaggggaaggccatcttgttggcataagggggacagaagatataatatactctacactccggnctcttccctacaacctaaaagggagaggagttgaggccgatgggctaggactaggctttttggtaggcacattatagaagactgggtaaaga

SEQ ID NO: 9171 - DNA, 354 bp, Homo sapiens
  misc_feature (1)...(354): n = g, a, c or t
ctgtttatccaagcttgagctcttgccaagatgtggtttgtgaattccgaactctgtggnctgctctgaaggagctgtcacagatgcctggggtgcttgcagcctgaaatcacacaggccctcccccagtaccaacctatctgcctcgccactgggcccctttcccctctcaggacaggggactaccaagcccaaggacaaagctcctatgtccagagttgacgactttgctgtctctccatcatcttcaacctgatctccgtcatcttcaacctgatctattctttcatcatccgatgcgacttcaggaatggaaggaaggcttaagttcanatcggccatgattggagattt

SEQ ID NO: 9172 - DNA, 271 bp, Homo sapiens
  misc_feature (1)...(271): n = g, a, c or t
ntgtggnttanctggctttgctggtcgtaatggaggacaaaagtgccttctggtgaaactcagcttccatagtgatggaacctaagggtagcagagtttatggtgaccctgtagtgtatctccagaaatggtgatcgtttgaatgcatgtaagacattccctagggactccaagaaatattgattacaggaagatgtggtgctttgaaagggacttggtgttcctacatgaaccaagtgaaggcctagaattggcaacattcagaacctcg

SEQ ID NO: 9173 - DNA, 342 bp, Homo sapiens
  misc_feature (1)...(342): n = g, a, c or t
naaagaaacagatttcagaattaaaaatcaaaaaccaacaattggatttggaaaatacagaacttagccaaaagaactctcaaaaccaggaaaaactgcaagaacttaatcaacgtctaacagaaatgctatgccagaaggaaaaagagccaggaaacagtgcattggaggaacgggaacaagagaagtttaatctgaaagaagaactggaacgttgtaaagtgcagtcctccactttagcgtcttctctggaggcggagctctctgaagttaaaatacagacccatattgtgcaacaggaaaaccacccttctcaaagatgaactggagaaaatgaaacag

SEQ ID NO: 9174 - DNA, 372 bp, Homo sapiens
  misc_feature (1)...(372): n = g, a, c or t
naaaagtttccctagcgggccattccttagcaaaatgttggaatccctgttgctacattgactaaaaggtcatgatgaatggaatatgtaagacttggctcatagaaacctaatcagatggttagaggtgttggcagtttaggacctgctgtcataaatgngngaacaaccttttgtaacctaacctattgacctgcatgttttttctttaccccaattcattacatggaggctcaatcttgagtttgctttactggttcagcaaaagccaggaagaacaactttgtagtaatcaaaatgntatccaactgtatattgnttactttattgtaaatactgaacagtggttaataaatagttatatatttcttt

SEQ ID NO: 9175 - DNA, 354 bp, Homo sapiens
ctgaggcagacacccctttccggatctgaaacccagggcagcgctggatggagtcagtgtgccccactgcccccctgctcaccagcagtgcagcagggaccaggtcagtctaatcatcttaagccccgaattcagcacagagcccagaaccccctggggctcagaacctactggctaagatggacacgccttccccaggcttacccggtaaaggccagcagggacgtgcactgaatagatggcgtcgtcctctagctcagtgctgtggaaaggctgcagccgcgtagtgagctcgtccccaggggggcccccaaagggcttcagggcaagagccaggttcatacatggaaaagg

SEQ ID NO: 9176 - DNA, 338 bp, Homo sapiens
aaaagaaataaccatttgtttcagattaaattgaccattctatttttcagtcagcattctcaccaccaaatggcacctatcccctttaccctgtgttccttttgctttttgccgtaactcttattgtcctccaataaactgtgtaatctatcatatccatctccccttgctagaatataagctccatgagggtgggataatttggttttttgctcaataacaattgtcccatttatgtctttatcttttaagactattcatcttcaaataagacataaataaggttttattatagcaatatgctataatttttaagtgacaactcaagcacttgtttt

SEQ ID NO: 9177 - DNA, 461 bp, Homo sapiens
  misc_feature (1)...(461): n = g, a, c or t
tgcaaatccatgtctaaggtgcatggttgtgttcacttaacaattacgcaccttgactgtccaaatgtgagagtcttatggagtgggcactccctgctggaagggaaaggtgagactgaggtatgtgganaggaccctccttttctagtgcataggatcccagacgattataatcacacacaacatgccaagaaaaggggactgcgttatcagcancccttctgtatactgcaaatggagggtganaaggnngaactttgtttaattaggatgaaccatgtggngattacatacattaatgtccaagggacattgttgtggtcaattaaaaccatgtactttggacaaatataagaatcttaaaaagtagngggnactccttgttgaaaaagcaaaagggagnccatgagaaggtgcccttatctagtacacaangaatatanacnagccaagcaaagagg

SEQ ID NO: 9178 - DNA, 357 bp, Homo sapiens
  misc_feature (1)...(357): n = g, a, c or t
aaaagcttgncagagttgcacaaatctaactggtattttgtttttgtttttaggaggagatgttaaggtaacccatcttgcaggacgacattgaagattggtcttctgttgatctaagatgattattttgtaaaagactttctagtgtacaagacaccattgtgtccaactgtatatagctgccaattagttttctttgnttttactttgtcctttgctatctgtgttatgactcaatgtggatttgtttatacacattttatttgtatcatttcatgttaaacctcaaataaatgcttccttatgtgattgcttttctgcgtcaggtactacatagctctgtaaaaaatgtaattt

SEQ ID NO: 9179 - DNA, 435 bp, Homo sapiens
  misc_feature (1)...(435): n = g, a, c or t
nctgaggaatgacgcaggggcctgcaggcagctcacgcggagacaggtctgtggggccccgcgtcagaacccacttcacatcccaaagccccacctgctttgatcttcaatgctgggctcaatgtcagatctggctgaccagaggggctcaatgaggctcactggctcttcatgcaccctgctgtggcctgagcacgtccccccaaaacccacctgcttaagtcctcacctgcaaggggatggtattaggtggggcatttgggaggtcatccggtcacagggcaggggcacagcctcatcatgggaccatcaccctcacaaaagaggttgcatctactggtgctttcatcttgggcttccagcctccaaaactgaaactgatttctgttgtttataagccactaggtttacaatattttcttttttttttttgaa

SEQ ID NO: 9180 - DNA, 218 bp, Homo sapiens
  misc_feature (1)...(218): n = g, a, c or t
ccaaagtgggcagattgcttgcgctctggagctcgagaccagcctgggcaacatggngaaaccctgtctctaccaaggatgcaaaaaaaaagctgggcatggngggtgcatgcttgtcccanctactgaggaggctgaggtgggaggatcccttgancctgggaggtggagggtgcngtgagctgaaatggcaccactgcaatccaaggggggngaca

SEQ ID NO: 9181 - DNA, 157 bp, Homo sapiens
  misc_feature (1)...(157): n = g, a, c or t
caacctttttcgcgtacctggggnggaaactgctggcccaancaaatnactttgagcnatactnatgnagagggaccatcttaagggntntactgtcctgcnctaagacatggangggancagnngggccatcatcaaagnnttttactccatcttg

SEQ ID NO: 9182 - DNA, 167 bp, Homo sapiens
  misc_feature (1)...(167): n = g, a, c or t
aaaaacaaactacataaacagatctttcctataacctangaaagnggaatgncagaagncaacaaaatgtgataaacttaaagngctaaaacagaaggcncttcacaaantctgttcactgaaacagttatatatcctcgcttacatccttcactttacaannggca

SEQ ID NO: 9183 - DNA, 224 bp, Homo sapiens
aaaatttatcagtatagcatttcatttctatgcatgtatatgtatagtaattcataaaactaaatagcaaactgatattctacaccagttcatttatctcaatatatattttggaatataacggcaatattaaaaatatcaattccctctaagctgataatactataagattttacacaaagttaaagtttttgttttttctttttgaaaaagtttcattgttt

SEQ ID NO: 9184 - DNA, 345 bp, Homo sapiens
  misc_feature (1)...(345): n = g, a, c or t
naaaaatatgtactgtttccttttttgttgnttttntgnctgttattttttcttttgncctganctcancatagactaatactaccttaatgttaaaatctgaatttcttttaccattttgcttaaaagcaatatgctatttgcttattccgngccctgacatagataatttttgaattctgatanaatacaagtgtggtaaatgccatgtttgtactttatctaacatcttctctttcancaggcttgnnttttttatatcatgagattgtttgtgtgtcccctttcctctnctttgcttaacacaattatcttgngntgaaggatcctccacnatttcatgga

SEQ ID NO: 9185 - DNA, 306 bp, Homo sapiens
  misc_feature (1)...(306): n = g, a, c or t
aaactaagcaaaggtacacgttgtaacggtggggcatctgtgaaaaagatgtccctttcataatatatgcaatatattccagatgttttgagagattacagaagaggaggcctgcttcacttgcagataagtttattataattctccanaaatgtgcaggatgtgcattagcaaattgcactgtacttttcactccagcctgggtgacagagcaagactcccgtctcgggggcttaaaaaaaaaaaaatgctgtntctaaatgaatntgngnaattgggcccaaatgngggtttgctcagtattag

SEQ ID NO: 9186 - DNA, 189 bp, Homo sapiens
  misc_feature (1)...(189): n = g, a, c or t
ggaaagtgtaaatttatttaataccaaatgtttcctaagtttactttttgcacaatgcacagacacttttgggacaatgtatggttaaaaactaatattctaccaacagctccatgctgctctagnatcatcctgaagggacaaaagtaatggcagaaggatgnctggggtctccaaagtcccaggaac

SEQ ID NO: 9187 - DNA, 257 bp, Homo sapiens
  misc_feature (1)...(257): n = g, a, c or t
ctgagaattaactactgacagtatccagcacttctggaacacgcggtacagcctntttggctaatagttctgcanaattgaagtctggctcataagtgacactcttagaggagctgcaggaacagctacaggtttctgtganatcattaaaatctccaagctctaaaataacaaattcatcaacatcgcatttgcagaatctctttnacatcatggcaaggacgtgtttcagtnactgggctgacctgtaacacagc

SEQ ID NO: 9188 - DNA, 295 bp, Homo sapiens
  misc_feature (1)...(295): n = g, a, c or t
ctgcacgggggaggtgaagcagaaactcgctgagcctcaaggaatgtgaaactagcaagtacagataaggctcaaatgtattacatgaatcattatcaatctgtcttgcaggaagacctaggtagngaagatgaaagtgagaactcccactaataagtgagattctcaaaggggggaatgaggaaggagaccacctctcttattgtttcatacctcagaaaaagaaggaagaaataaaagttaaagaaggcaaaaatgagataaatagtcaggcagcctggccccgcaccccagg

SEQ ID NO: 9189 - DNA, 225 bp, Homo sapiens
  misc_feature (1)...(225): n = g, a, c or t
nggtaaaatcatttatataaagtcattaggatcatttaggaaagagaggatggaaactaacatttattaaaaactaactataccaggtaccttattacattattttatttaatcatcatgtatccctataagnaagtattcttctcttttatagcagtaaggaaatctgagcatgtcaggcaatatctaatgttgcnccaggnatcatccgcaagctgggcaatg

SEQ ID NO: 9190 - DNA, 373 bp, Homo sapiens
  misc_feature (1)...(373): n = g, a, c or t
aaataaaattacnagctgnaaggaaaatgaaaagccacaaatgcaagactgttcttaaatggaaggcatagtcagcgagggtaaatcctataccactttaggaagtattaaaaatatttttannatttgaaatanatttcatanaagncctctattcaaaatcatattccacagatgttccccttcaaagggaaaacatttggggttctaaacagttatgaaagtaagtgatttttacatgattccanaataacacttgtattgaccaatttagacagataccacgaccaattttgcatttaagaaattgttctgattatttacgtcnactcattagaantcagngaaangtcacagtcttttgtcacagaga

SEQ ID NO: 9191 - DNA, 271 bp, Homo sapiens
aaacaaataaaaggtcttggggaattctgtttggctacctgggcacgccagtctgcaccatgtgtccctgcggcgcatgagtgactggcgtatttagcccgtcacatttcattcgctgaaggaaaggcaagagagttgaaacatttttcttacttaaaaaaaatgatctttgtgaagaacatagtgagttcgtttgtcttcagtcaacagcggctgaaactgaccactgagaaatgggtgtgggcactgacagttctcccccattatttgg

SEQ ID NO: 9192 - DNA, 477 bp, Homo sapiens
  misc_feature (1)...(477): n = g, a, c or t
aaagtgatcaggttcattttattgactacacagaagcaattccattttccactaacaaaataatttaggatgaagaattctgactcagtgtctccacaggaacctgttcctcagctttctggatgtcattgtttctgacatcacaccttcctagacaggtatttctggaaaaggatctggtaagaggatgaatttggctctaaacaaatgcccatggccccggaagacctgttggggccaccgagttagtttctctggcaaaatttgattccttccatctcaccactatagtaactgttgttgttatgttaccaggagccacacaaaggttgacccatcaaggnggagccaccgttaccaggagccacacgaangcttgaaccagcaaagtggaggaccanacctgcccgggccggcgcgntcaagggccgaaattccangcacactggcgggncgttactagnggatcccgagntc

SEQ ID NO: 9193 - DNA, 262 bp, Homo sapiens
  misc_feature (1)...(262): n = g, a, c or t
ggggaaatggcattcttggcaaagagaacagcatgtgcagaccaggagcaggagcaaggaggggctgacagatggtggcactagggacgttggcagggtcagactgtgccagccttgaaggccaggggagaccctgggactgtggcgtggtcatgggaaaccaccactgacagttntggagcaagggcangatttggntttaggaaacncactttctctggnaagacctacaggtttaacggtccntccttcctcattgnaa

SEQ ID NO: 9194 - DNA, 146 bp, Homo sapiens
  misc_feature (1)...(146): n = g, a, c or t
gnaacacccaacagnaacctctgntgttactctttgactaaaataattattttagntaaaaaaaaaaaaaanaanaaanaaanaaaccaggtaacnctatncaaaaggaagcngngnaagatctgaaacaaaattttctcttttnc

SEQ ID NO: 9195 - DNA, 347 bp, Homo sapiens
  misc_feature (1)...(347): n = g, a, c or t
nggtctggtctccctccaccctctcatatttacacccaaccccttccccaaagctagcttttaccaaagttcctggtaggaggtcaagaagtgtgtccacttagccagcagtcctagatgtagtggacgctgtttgtccccaggccagttgggcaccaggaggggctactctggggattcagggcatagacttcgtactggggtcaagggaggcccccactcacagatactctcctttccttctggggctcaatgtacaccaaaaccttcagaaagcaaagttggagtggtggacccccaatgtcaagtttagtgctctctttgcttgtgaggacccacacaagtgg

SEQ ID NO: 9196 - DNA, 364 bp, Homo sapiens
  misc_feature (1)...(364): n = g, a, c or t
ntgancgtgaagcacaccccgaagttggagatcaaggtcactcccagtgatgccatagtgagggagggggactctgtgaccatgacctgcgaggtcagcagcagcaacccggagtacacgacggtatcctggctcaaggatgggacctcgctgaagaagcagaatacattcacgctaaacctgcgcgaagtgaccaaggaccagagtgggaagtactgctgtcaggtctccaatgacgtgggcccgggaaggtcggaagaagtgttcctgcaagtgcagtatgccccggaaccttccacggntcagatcctccactcaccggctgtggagggaagncaagncgagtttctttgcatgtcactgg

SEQ ID NO: 9197 - DNA, 373 bp, Homo sapiens
  misc_feature (1)...(373): n = g, a, c or t
ctgtancttctgtgggacttccactgctcaggcgtcaggctcagatagctgctggccgcgtacttgttgttgctttgtttggagggtgtggtggtctccactcccgccttgacggggctgctatctgccttccaggccactgtcacggctcccgggtagaagtcacttatgagacacaccagtgtggccttgttggcttgaagctcctcagaggagggcgggaacagagtgaccgagggggcagccttgggctgacctaggacggccagtttggtccctccgccgaagacgacatggtcattattacgatcccacacttgacagtaatagttggcctcatcgccggcttcgaccctgttgatggtcagggtgg

SEQ ID NO: 9198 - DNA, 364 bp, Homo sapiens
aaggcccttttctccaaaaaattcattccactttcatcttctgaatcggagttggaatcagtcacagaattctctgagggctggcgggactctgcttttttgttggttgctcccctggtactccgcgctggaaacttcatcgccaccctgagaggtccagagtgcctgcactggctgcgggtcctacagccttcccgaactgactgcagcctcgtgtttgcaaaattatcagaagcaaagctgtcacaactgtcatcagaggatgacgaggtttccatggaaatcaacttcacatatctgaatttctttaagttcttctttactctgagatctttctgcggcacgcggcgagcgtccatgctgg

SEQ ID NO: 9199 - DNA, 273 bp, Homo sapiens
aaaaatctctctcgtgggtaaagtcactttccccttggcatctgacttcagcaccatctgggccctacagaaactgaggccagtggaggaaatggctctggacaaagggctgctgcttggatgtggccccagcgatggtcagtctgagatcgacactcctagagtccaccaatctctctctggaggcttctgaggttgatccccatactccccacaccaggtctacaactccataataatggctaaaaattatttcttatttatttgaaattt

SEQ ID NO: 9200 - DNA, 126 bp, Homo sapiens
  misc_feature (1)...(126): n = g, a, c or t
ctgtagcttctgtgggacttccactgctcaggcntnaggctcanatanctgctggccgngtacttgttgttgctttgnttggagggtgtggnggtctncactcccnccttgncggggctgctatct

SEQ ID NO: 9201 - DNA, 415 bp, Homo sapiens
cctcatccggctttgacccaccatccgttgcagaagcctccaggagcagcaatcctaagagtgggaggcagccaagacccccttccttcaaaacctcccggaagtggtttcaggccctctagttgccatgaccaatttgtgtgtgtgtttaatttttgcttcaagctctgtagcaggacctgccccacgcacacccctacccctctgtgaggagctgtgggaagtgtgggtttgtctccagaacagaagagaatgatggatattctggctctggggccctctccaccaccactcacagtagccttgctgaagccatcacagatgggagaaggccatgccagccacgtccgccgaggggcgccagcctgaagctgccaggccctgaggttcagaccctggaccccatagctggagg

SEQ ID NO: 9202 - DNA, 371 bp, Homo sapiens
cctccttgaggatgaggctgattatgtggtccccgtggaagataatgatgaaaactatattcatcccacagaaagcagttcacctccacctgaaaaaggtaagagtttgtcgccttaagcacctgaaaatttttagcagttgatcaggatgtataagagtatttggtagtaagcactaagaggctcagaaatgacagtgcccaggactttctcccctgggccacagtgtgtgcttctttggctggttgggcagacagcatcagtgacaacccatctctgtgtatcatagcccttccctgccttccccttcctcttccatgctttaatcttcccatctcacattatgaaagcacctgggtagttctcttcag

SEQ ID NO: 9203 - DNA, 360 bp, Homo sapiens
ctgatgtcacagtgcagacatccaccgttccaccacagaaccagtggctgagcggaccaacgttgccatgtgcgtttgctctgtggggaacagagcacagagggtgagcgacatgtgcagaacggccccttggctgcagttaggacctcagtggctggtatggccgagctgctagaagatgctgctgtccctgtgatcccagcagccctcccttcaccgtgacccctgacctttgtcaggaaggtgcagtttttcttctcaatctaaatgcctttcaggtgggccgcttccttggctacctggttccagggggctgttttgtaatgagatgctgctggcaggccactcagaggctcccag

SEQ ID NO: 9204 - DNA, 606 bp, Homo sapiens
  misc_feature (1)...(606): n = g, a, c or t
aaattttgagacagtataaggaaaatctggttggtgtcttacaagtgagctgacaccattttttattctgtgtatttagaatgaagtcttgaaaaaaactttataaagacatctttaatcattgcaaaaaaaaaaaaaaaaaaaaaaaaaaaacctgcctgggcggccgcccgggcaggtccttgcctcanatccaaggtcactcggaagaggccatgcctaccctcaatgacactcatggaggaaatgctgagagaagcattcagatgcatgacacaaggtaagactgccaaaaatcttgttcttgctctcctcattttgttatttgttttatttttaggagttttgagagcaaaatgacaacacccagaaattcagtaaatgggactttcccggcagagccaatgaaaggccctattgctatgcaatctggtccaaaaccactcttcaggaggatgtcttcactggtgggccccacgcaaagcttcttcatgagggaatctaagactttgggggctgtccanattatgaatgggctcttccacattgccctggggggtcttctgatgatcccagcagggatctatgcncccatctgngtgactg

SEQ ID NO: 9205 - DNA, 216 bp, Homo sapiens; identical to SEQ ID NO: 3766

SEQ ID NO: 9206 - DNA, 367 bp, Homo sapiens; identical to SEQ ID NO: 144

SEQ ID NO: 9207 - DNA, 408 bp, Homo sapiens
aaattggaaaattgaaatcccaagtgggcaagcaagggctccagcctagcactcccttttctctcccacatagcatgagggagagtggaaaggtaggagtgggtgggaaagtgttgcacccagcctttccactccaaacctcgtattgctttcttgaggttggtggtgaccaggatgtatcattttaggtcatgtccaaagtaatggagatgttccagcctagtgcggtggtcttacagtgtggctcagactccctatctggggatcggttaggttgcttcaatctaactatcaaaggacacgccaagtgtgtggaatttgtcaagagctttaacctgcctatgctgatgctgggaggcggtggttacaccattcgtaacgttgcccggtgctggacatatgagacag

SEQ ID NO: 9208 - DNA, 248 bp, Homo sapiens
ccaaagaagcagcggcttgggccttcacccagtgggcccttctctgtgatatagtcaaagagatcctgggcgggcaaaggccgctcgaggaccagcatgaagccctcctgtgtctcaaaccagtcaagcaggcggatcacgccagggtgcccaccacctgcacccactttccatagcagtgcgacttcgagtgggcatgtgactgagtctgacaagggggaccagcccagcacacgattccggggaat

SEQ ID NO: 9209 - DNA, 90 bp, Homo sapiens; identical to SEQ ID NO: 145
  misc_feature (1)...(90): n = g, a, c or t

SEQ ID NO: 9210 - DNA, 343 bp, Homo sapiens
  misc_feature (1)...(343): n = g, a, c or t
ctgtggatcctgattctggactggaacactctgcgcatgtcctggagaaaggtgggaaggtcttcagtgccacccttggcctggtggacatcgttaaaggaaccaactcctactacaagctgcagcttctggaggacgacaaggaaaacaggtattggatattcaggtcctggggccgtgtgggtacggtgatcggtagcaacaaactggaacagatgccgtccaaggaggatgccattgagnacttcatgaaattatatgaagaaaaaaccgggaacgcttggcactccaaaaatttcacgaagtatcccaaaaagttctaccccctggagattgactatgg

SEQ ID NO: 9211 - DNA, 291 bp, Homo sapiens; identical to SEQ ID NO: 146

SEQ ID NO: 9212 - DNA, 197 bp, Homo sapiens
ccattggttcccatgacaacgtgatctacatctatggtgtttccagtgatggtgccaaatccagccgctttggccgctgtatgggtcactccagcttcatcactcatcttgactggtccaaggatgggaatttcatcatgtccaattctggggactatgagattctttactgggacgtggctggaggctgcaagcag

SEQ ID NO: 9213 - DNA, 244 bp, Homo sapiens; identical to SEQ ID NO: 147

SEQ ID NO: 9214 - DNA, 91 bp, Homo sapiens
ccagtgaggaccggaggagccctgggggccagggagaccacggtcgcccttctcaccctgttcacccggaggaccgatgagcccgatcagg

SEQ ID NO: 9215 - DNA, 157 bp, Homo sapiens
ccacgctgctggcctgggctggcgtctcctgctgtgagctggctgaggaggacttcctggcggtctcccccttagatccgcgctatcgtgaggtccactatgtcctgctggatccttcctgcagtggctcgggtgagatggtatgccgagcagacag

SEQ ID NO: 9216 - DNA, 406 bp, Homo sapiens
cctctaaccttgagagtgtcattgccttgttacatagcatgatgtcttaccccagaagaaaaacagggaaatatagaaactcctaccctcccacatgcacagatttctgggtgatgcctccccaaggagtagagatagaagaagcagcaaagacaagggcagagacccagcaccactatgccacacacttgatgtcagataccaccaggaaagggaaaaatcacattccaaattacaaaggaaatggaaagatggaagaccgaagacacagattttgctgcagcaattccttggaacgtgagagcactctcttcgaaacctcttctctcattctctttggaagcccaaactgggttcttgagtttggggaagatttatggaacagatgatgcctaccattgccttt

SEQ ID NO: 9217 - DNA, 166 bp, Homo sapiens
cctggacgaggaaggctcctgacactcactaggactgtgactagatgttccagtggcagaaagtcctcctggtttccttcgggccctggcgtaatgcagcagagcagcagcagcagcaaggacgaggatgctgagcaccagccccgtgattcccgcagcggtaagg

SEQ ID NO: 9218 - DNA, 126 bp, Homo sapiens
cctcctcctttcgctcctgaagtcagaagcgccagcctttggctctcaaaattgggagcgatttggtggagaggatggggtagggaggatgggagaacagcgcctttatctgggacagacagaagg

SEQ ID NO: 9219 - DNA, 322 bp, Homo sapiens
  misc_feature (1)...(322): n = g, a, c or t
gatcgcgccaccacactccagcctgggcgacagagcgagactccatctcaaaaaaaaaaaaaaaatactgagtagcaaattcttaattccaagtaaagattaacacctttctattaaaaaaaaaaaaagatgaggagagaataaactatttcctattattattctagctgggtacacaggcntgcacttgtagtcccagttactgaggaggttgaagggggaggattgcttgagtctcggaagtcaaggctacagtgagctgtgatcatgtcactatactccagcctgggtgaaagagtgagatactgtctccaaaaaaaac

SEQ ID NO: 9220 - DNA, 291 bp, Homo sapiens
ccttcacaacctacgaaactacagtccagatttgggaaagcagccgaaaaaggtgcctaaacgtcgccaggccgcccgagagctgtccattcagcgccgttctgccctcaatgtgaggctcttcctcagagacttctgctctgagttcctggagaactgttacaaccggctcatgggatcagtagaggatcacctgcttcgggagaaagctcagcagcatgatgagacctattatatgtgggccttggctttcttcatggccttcaaccgagctgcctccttccggccagg

SEQ ID NO: 9221 - DNA, 340 bp, Homo sapiens
ctgccagactattcccacagtgctccaaatgcacatgaacaacagtgacggctccagccttcgacccagagccccgtgcccagtgcgtcagtgggcctggggttccaggctacatcaagcactgatggtgtcagggctggtagttaccaaatcagggttaagaaacatcagggccacatttcactaccttcacagatcaaactcagcagcagtcatgactgtctgtcactacactggggatcccaattccacataagcacttttggaagaaaacagccaaagttggcctaaaattggcgctggaatttgggctgggaaaaatcttgtggttatttccttt

SEQ ID NO: 9222 - DNA, 205 bp, Homo sapiens
  misc_feature (1)...(205): n = g, a, c or t
ctgatgcctcactactagatgcagtgctgggaccttcctcttttggagctgtcccatgtacagnggacccaagctcaggaccttcgtggagctgcttctccaacctgagaaactcaagacccatcctcccgctgtcactttggacaatggaaatctacattttcttttcccttttttttttttttganananagtctcgccctgt

SEQ ID NO: 9223 - DNA, 221 bp, Homo sapiens
ctggacttgtttgacgatgttggtactttcgcctctggacccccaaagtacaaggacaatcccttttccttaggggaaagctttggctcccgctgggatacagatgctgcctggggtatggacagggtagaggagaaggagccagaagtgaccatctcaagcatccggcctatttcagaaagagccacaaaccggagggaagtggagagccggagctcagg

SEQ ID NO: 9224 - DNA, 473 bp, Homo sapiens
ctgcagagcccaccccaggaggagcctgcctctccttacaaaggctgtaataagacagcacttgacgatgccatacgtgcgaaaagtgcagagcctcagagggtttacaacccccatccctttgtaactgtagtttgcttacactgtggattctaaagagacatgtaaatctggggccgatttcatctgtttaatgattactccccacccgatagagctattctatactgttgctaaaatttcattaagtctctcaagatgcattgatgagatgagacaccatgaataacacattcatcaactcaagtatggcaactgttcagagagcttcagagctttggtacccgagtgcagacttggtaattaccgggaatttgtctcccccgtataaattctggcgaacaacgagaaaacaccatctgtgatcgtttccacatcacgtttgctaacagagcacttctggagagcaatgg

SEQ ID NO: 9225 - DNA, 252 bp, Homo sapiens; identical to SEQ ID NO: 2678

SEQ ID NO: 9226 - DNA, 360 bp, Homo sapiens
ccttcggtccaattcaggccaccctctgttttcttggctcttgaggcttttgttggtttcaggcctgaggcttctatctatcttggaacatgggctttccatcttagtcctcgggtctcaagtctcaaaccatctgtcttatactttgggcctcctatccatatgagccttccaccttctgccctacttgagttctgggttttactgcagtctagggccttgttttggtcttggatcatctcacatggcagcctggcataaggaaccgctccacaatgcttgctctgatagccgacgttctgcacctatcaggcaggggttaggaagcccctctgccacacatgacacacacacacgtac

SEQ ID NO: 9227 - DNA, 302 bp, Homo sapiens
  misc_feature (1)...(302): n = g, a, c or t
ctccaacccttggaataatccgagtgctccatcttcagtgccatctggactcccaccaagtgcaacaccctccactgtgccttttggaccagcaccaacaggaatgtatccctccgtgcctcccaccggaccacctccaggacccccagcaccctttcctccttccggaccatcatgtcccccacctggtggnccttatccagccccaactgtgccgggccctggccccacagggccatatcctacaccaaatatgccctttccagagctacccagaccatatggtgcacccacagatccag

SEQ ID NO: 9228 - DNA, 311 bp, Homo sapiens
ctgaatatggaagagatctttttttactagagatctgcagaagaaacgcaatcttctgagcacaatatggaatctaaaggttttatcacttagttgttcatattatgaacctaaaaataatggcataaagtttggggatgccaggcatactttttcatgtttggtgttgagttattttacttttctaacccaacattccttggtgagaccattaaatccaaacacttgtcaccgttccttctcatagtcactctgggtcatcagcatgtcccagtcactgcagcaacgccttgtgtttgtttcattttttt

SEQ ID NO: 9229 - DNA, 228 bp, Homo sapiens; identical to SEQ ID NO: 329

SEQ ID NO: 9230 - DNA, 377 bp, Homo sapiens
aaaacaagcaaattttattaaaggaaaattttgcaggtttaaggtttgcaggtgaaattttgtaggtgaaaaggtttacttttcaccagtctgttctggcatgcttctaatgatgtcagagtcacctggatcaatgatagccagtgtgcacactctgtagtattttccgcatgctgtgcccagttcaatattattgccactgtagtgatggacaccagttttagccaacatagcatagtactctatttcagatttcctcaaagctgggcagttgttagcgagaatgaccaatttcgctttgccttgtctgatcatcttcagagtctgcttgtaccccaggacgtacttcccacttttcataacgagttggagcctag

SEQ ID NO: 9231 - DNA, 162 bp, Homo sapiens
  misc_feature (1)...(162): n = g, a, c or t
ctgggaacncacatgctatgtatgtcaccatgtgatcacaaccacagcacatgtgaagtgctacaattactcctnanagcggtggaatggcanangagcttgcatgaaaaatcagaacatacccgtacaccaaagcaattcaaaaggaccaagtnaccctca

SEQ ID NO: 9232 - DNA, 433 bp, Homo sapiens
cctggaagctcctacccaaccctcatttgtttcaactcactttcaatatgtgcatagttttataaagcagacatttccatgaggaaaagaggatggtggtgaaaggggaggggtgaagggacatctccaagtcacagaggctgcaaaactcagcatgacttgtggacggagccacaggccacccagggcaacaacacccacataactcaccaagtggttaacggctctaaaccagggtcaacaggagaggggacaaaagtcactccttgattttgctgcagcttaaagataagttctacctcagcttatgctagcccttatggggcaaaaaagggaaagtcattctccccaagtccaggctgggccgtcaaacagggagtggggtgtcagccccagacctcaatgaggtccccagattccatgcccaggtcag

SEQ ID NO: 9233 - DNA, 549 bp, Homo sapiens
ctggagcctgagtccgctgcacggagactctggtgtgggtcttgacgaggtggtcagtgaactcctgatagggagacttggtgaatacagtctccttccagaggtcgggggtcaggtagctgtgggtcttagaaatggcatcaaaggtggccttggctgcaaaacaaaagaaccccaggagggtcagtggcgtgcttgaggcaagtcccccaacccaaaaattgtcgcactcctaggaacagagaggccattctgggcgggtctgtcgtgcattaggagagcctttctctgcctccctgaaaacacgccaagcacacactggacccgtgtggttaagcggagctgagagaccatggctatgccccatgtgtggaccacctaccgaagttgcccagggtggcagtgcagccccgggctgaggtgtagcagtcatcgataccagccatcatgagcagcttcttaggcacaggtgcggagacgatgccagtgcccctgggtgcagggatgaggcgtaccagcacagagccgcagcggcctgtcaccttgcaa

SEQ ID NO: 9234 - DNA, 561 bp, Homo sapiens
aaatcctattatcaaaatttgggggggtgatgattaagtaaggtaatgtatataaacatgtagtgcagtgtctggcacatagtaaacaaattttttattgacagatattataacataaataagttttacctgatggccttccttgataatctattcgctctcctcgccagtactccaaaggtttcaaacgtgttctcttggtcctgcgaacatttggtgtgttggagggcaatactagtttgtgatggattctgttctttggtatcactttagattgttttgagtcatctgaacttccatgaacttcctcatcatccacatcattctttccagacattaaataattattattgagcctggaaggtccactttcctctaaaactgaagtcttatgctctccagaatccaagtttgactctgttggtatattacatgtatatccactggtctgaggctttaggggaacattctgtgcagtcataatgttatcttcattctttgagcttcttgtagatctagaacaatcaagatttttcttcttagccaagtctgcctcatcac

SEQ ID NO: 9235 - DNA, 58 bp, Homo sapiens
aatcaataaagcttgccttaaattatttttatatgactgttggtctctaggtagcctt

SEQ ID NO: 9236 - DNA, 254 bp, Homo sapiens
atcaaacaaaagtcactgaggaagaaaataagggttcaggtacaggtgcagccggtgcctcagacacaacaataaaacccaatcctgaaaacactgggcccacattagaatgggataactatgatttaagggaagatgctttggatgataatgttagtagtagctcagtacatgattctccgttggcaagtagccctgtgagaaaaaatattttccgctttgatgagtcaacaacaggatttaacttcagtttt

SEQ ID NO: 9237 - DNA, 291 bp, Homo sapiens
ctgcttttatacccccttgccccgccaacgtagttaagagaacagcagcataagcggctggcagaggcaaggaaagaccagtagagagaaaaaaaggccatctataccaattctaagttaatttagactaaacaaggtcttaatagcaaaggataattgaaatcccaaacttacaaggttttcaacaaaagtgaagtttgcttaaagttaacagtgtaacatgtattatggtaacttctaatcttgtggccttagacagtctagtccaaaggcataaagaaagtttgcttt

SEQ ID NO: 9238 - DNA, 513 bp, Homo sapiens; identical to SEQ ID NO: 148

SEQ ID NO: 9239 - DNA, 319 bp, Homo sapiens
cctgcctgctgtagtttatttcttttgccttgttcagtgaatttacccagagggtggctgagattgaggctttgggagccccaagaagctgcttggttttaatgtgctaccttatagctgagcctgttgtgctcagggcaagtagtaggatgttccccctgggatgtgcaaggttctctcaagcagacatgagcctccatcactcccaccactccctgcaactcagcctcctcttctcagcctgtgccttcctccagttctagtaaacactgccaaatgaatatagttctccgactcttctctgggggttcattggcag

SEQ ID NO: 9240 - DNA, 216 bp, Homo sapiens
cctgtgtgtcctgctcagccactctgtcgaccacactgacccaggggctgccccggacatagaagcggaggggtttccgggcccactcccctgcatggccgacgcccacccgggctgctgccactacagccggctcactgggctccaggggaccacgctccagccatacagcttcatcctgtgccaggtccctctggtcaaagctcttgttgatgg

SEQ ID NO: 9241 - DNA, 223 bp, Homo sapiens
ctgagggtacagctctgagaattggcgctggaaacagttcttggactgtgatagccacaacagatgctgtttctgggatcccaggaccagggctctggaagatgccactgcagtggtagtgcccgctgtctgccttttgtaccacggtgatggagaattccctgttaggcccggggggacccagagctgagccatctcggtagaaggtcacctgagtcagtgg

SEQ ID NO: 9242 - DNA, 359 bp, Homo sapiens
  misc_feature (1)...(359): n = g, a, c or t
ctggcttctggcccctgcttcacgcccccagcgccgncgnccnttcctgagtggagatgaggatcccaaggcttccacgctacgtgttgnggtctttggctccgatcggatttcagggaaggtggctcgggcgtacagcaaccttcggcggctggagaacaatcgcccactcctcacacggttcttcaaacttcagttcttctacgtgcctgtgaagcgaantcatgggaccagccctggtgcctgtccaccccctcggagccagacgccctcacccccgacagactcccctaggcacgccagccctggagagctgggcaccaccccatgggaggagagcaccaatgacatctcccact

SEQ ID NO: 9243 - DNA, 306 bp, Homo sapiens
aaaaactggcccttacctgacagagccctggctttgacctgctcagccctgtgtgttaatcctctagtagccaattaactactctggggtggcaggttccagagaatgcagtagaccttttgccactcatctgtgttttacttgagacatgtaaatatgatagggaaggaactgaatttctccattcatatttataaccattctagttttatcttccttggctttaagagtgtgccatggaaagtgataagaaatgaacttctaggctaagcaaaaagatgctggagatatttgatactctcattt

SEQ ID NO: 9244 - DNA, 373 bp, Homo sapiens; identical to SEQ ID NO: 6

SEQ ID NO: 9245 - DNA, 393 bp, Homo sapiens
ccaagactggtggcctggaaatagactcagattttggtggcttccgggtaaatgcagagctacaagcacgctctaacatctgggtggcaggagatgctgcatgcttctacgatataaagttgggaaggaggcgggtagagcaccatgatcacgctgttgtgagtggaagattggctggagaaaatatgactggagctgctaagccgtactggcatcagtcaatgttctggagtgatttgggccccgatgttggctatgaagctattggtcttgtggacagtagtttgcccacagttggtgtttttgcaaaagcaactgcacaagacaaccccaaatctgccacagagcagtcaggaactggtatccgatcagagagtgagacagagtccgagg

SEQ ID NO: 9246 - DNA, 375 bp, Homo sapiens
ccattcccccagccttctccatgacgtaggccatggggttgcattcgtacagcagtctcagctttccattggggctcttcttgttagcggggtacagaaatatccctccgtagaccagagtgcgatgaacatcagccaccatggagcccacataccgggccccataaggagctgaattatctggggggaacttcttcctctggatgtactcattgacggcagggtcaaagtccttggcgtagccctcgttaaggctgtagattttacctttcttttttatcttcacatccttgtccaccaaaatgaactccccgatggcctttttagacaaggaaggaaaggtggagagatgacgagcgcactgggtcccccagg

SEQ ID NO: 9247 - DNA, 268 bp, Homo sapiens
  misc_feature (1)...(268): n = g, a, c or t
gagtgtattcgcatctacgacgtgcacacctgcaagtagggcaccagggcgctgggaaggggtgaagtgtgtggctgggcggattcagcgaagtctcatgggaagcaggacctagagccgggcacagccctcagcgtcagacagcaaggaactgtcaccagccgcacgcgtggtaaatgacccanacccaactcgcctgtggacggggaggctctccctctctctcatcttacatttctcaccctactctggatggtgtgtggttttt

SEQ ID NO: 9248 - DNA, 377 bp, Homo sapiens
ctgtggcgggtgttagagatgtctgacatcgtcctgcttatcactgatatccgacatccagttgtgaatttcccgccagcactttatgagtatgtgactggagaacttggactggccctggtgctggttttgaacaaggtggatctggccccgccagctcttgtggttgcctggaagcattatttccatcaacactatccccagctccacgtcgtccttttcacctcttttcctcgggacccccgcaccccacaggatcctagtagtgtcttgaagaagagtcggaggcgggggagaggatggactcgggccctggggccagagcagttgctgagagcctgtgaagccatcactgtggggaaagtggacttgagcag

SEQ ID NO: 9249 - DNA, 181 bp, Homo sapiens; identical to SEQ ID NO: 149

SEQ ID NO: 9250 - DNA, 329 bp, Homo sapiens
  misc_feature (1)...(329): n = g, a, c or t
ctgcctgagctgtggctccatggagtgggggaactgctccaggggccctggatccaggctcacagtgaaagctgctttgttaccagctcgggcgtagtccatttctgtgtatttcgtgaaccactcattcacctcctcctttgtgcggttggtgaacaggagacccacctcacccctcaaccttttgctgacctggtgcaggttgtctttgtattcatcagatgggctccgacccaaggccaccatcatnaccttgtttttgccaaagaacatncngctntgcttccaggcgttccggatgtccttcagcttgctgttcctcatgttgg

SEQ ID NO: 9251 - DNA, 296 bp, Homo sapiens
ccacgctggaggagccccaggagggcttggagtttgcccacatggccctagcactcagcatcaccctgggggaccggctgaacgagcgcgtggcctaccaccggctggccgccctgcaacaccgactgggccatggcgagctggcagagcacttctacctcaaggccctgtcgctctgcaactcgccgctggagtttgacgaggagaccctctactacgtgaaggtgtacctggtgctcggtgacatcatcttctacgacctgaaggacccgtttgatgcagccgggtactaccag

SEQ ID NO: 9252 - DNA, 310 bp, Homo sapiens
  misc_feature (1)...(310): n = g, a, c or t
aaagaggaagctggcgcgtatggcagccgaggagcacactctgcaggacactggacaagacagtaaatattcaacttttaatgctgattaaaggagtataggtaaagaatacgtaggtatacataattggtgagacaaatattcactttatttatattttatatattatttttttaatttggtaaatactatccagttttgtagttgtccttgttgatttgtgtgatattaaagtattagtaataattgccaggaaactatcattagggagggtttagttggttgctgtttggactggganggatgattt

SEQ ID NO: 9253 - DNA, 521 bp, Homo sapiens
  misc_feature (1)...(521): n = g, a, c or t
aaaggtgtgtgtattctgtttgcatctccctgtcactgtgacacacctagatgtgtgttacttcaattaaaattctcaaatttaattttgatttgcttcagaagggaaaatattctcaataatgtaaaataattaaggtctatacatgggttgtatttttctggttcacaacagcacaaagtgtctttcatttttttgttggttttcttttaagatcttttttaccctgaagtcagtgaatacttttctagtttatttgatactctttctgtgtatatattaagcttttgctgtagattgcctagtaaaattactaaggataggttgtttttacatatggtctatttaagtctgatgtttacgggggaaagtgtanttactaaaaatgtttaacataatttggaagaagagtatgaacaaccaataccaatacctattgcgtttggattcttaagaccccagtttgttattccactaaactagttatcttaaccatatcatctggttttgngggccattat

SEQ ID NO: 9254 - DNA, 397 bp, Homo sapiens
aaacattattcactactgtttttgaagtgagaaagtatcagccatttagcatttaagttggggtatttagagcctgtaatctaaatgctggctcaaatttattccccagctacttcttataccactattcttttaatgtttgcataatcataagcacctcaacacttgaatacataatctaaaaattatatagtaaagctggtagccttgaaaatgtcagtgtgatatctattatgtagataaatatatatagtggcctttcaggactgtcacagtaacactttatttacagagctaatgtttgtcctaaattttcaggaccctagaggagagctttatacaattaccgatgtgaatttctctaaagtgtatatttttgtgtccagttatattattt

SEQ ID NO: 9255 - DNA, 255 bp, Homo sapiens
cttgacgaggctgcggtgtctgctgctattctccgagcttcgcaatgccgcctaaggacgacaagaagaagaaggacgctggaaagtcggccaagaaagacaaagacccagtgaacaaatccgggggcaaggccaaaaagaagaagtggtccaaaggcaaagttcgggacaagctcaataacttagtcttgtttgacaaagctacctatgataaactctgtaaggaagttcccaactataaacttataaccccag

SEQ ID NO: 9256 - DNA, 385 bp, Homo sapiens
ctgctgcactgcactttgcgattcaacaagtcagggaagaaaacatcaggaagcagctaaagaagctggactgcgagagagaggagctattggttttccttttcttcttctccttgatgggcctgctgtcgtcacatctgacctcaaatagcaccacagacctgccaaaggctttccacgtttgtgtagcaatcctcgagtgtttagagaagaggaagatatcctggctggcactctttcagttgacagagagtgacctcaggctggggcggctcctcctccgtgtggccccggatcagcacaccaggctgctgcctttcgctttttacagtcttctctcctacttccatgaagacgcggccatcagggaagaggacctcggccg

SEQ ID NO: 9257 - DNA, 529 bp, Homo sapiens
aaaagtttttatttacctaaaaacataaatttatcaaacatatcaatttgctttgcagagcaatttacataaaaattcatgatgtataccaacgacagcatagcattatctacctcagtttgtgaagcatcctttcctacagatctcagcaaaacgcagagccagtaggggaaattcaagctttcatttgggggcctctggggtcctacctgctggcagttctttcagcagaaagtggggtacgggggatgctgaagagggggaagtggaccccattgcctgttaagtcccatctgtctcagtttgaagcaacacgggaatttccattggaggagggttggcctgccggcctggcccttctctcacgccccctctacttcagctacatttcttatgcatgttcctcaaagctgtgaaaatcaatacaaaaaaaactgacctttacttcattcctgtaacaggctatcaggatctcaaggagatccacctgcatcgagatcagtctcaaaaacggggcatgtaaaacata

SEQ ID NO: 9258 - DNA, 494 bp, Homo sapiens
ccttatttctcttgtcctttcgtacagggaggaatttgaagtagatagaaaccgacctggattactccggtctgaactcagatcacgtaggactttaatcgttgaacaaacgaacctttaatagcggctgcaccatcgggatgtcctgatccaacatcgaggtcgtaaaccctattgttgatatggactctagaataggattgcgctgttatccctagggtaacttgttccgttggtcaagttattggatcaattgagtatagtagttcgctttgactggtgaagtcttagcatgtactgctcggaggttgggttctgctccgaggtcgccccaaccgaaatttttaatgcaggtttggtagtttaggacctgtgggtttgttaggtactgtttgcattaataaattaaagctccatagggtcttctcgtcttgctgtgtcatgcccgcctcttcacgggcaggtcaatttcactggttaaaagtaagagacag

SEQ ID NO: 9259 - DNA, 320 bp, Homo sapiens
caacgatgaggctgctgtcatttgtggtgttggctctatttgctgtcactcaagcagaggaaggagccaggcttttggcttccaaatcactgctgaacagatacgccgtggagggacgagacctgaccttgcagtacaacatctacaatgttggctcaagtgctgcattagacgtggaactatctgatgattccttccctccagaagactttggcattgtgtctggaatgctcaatgtcaaatgggaccggattgcccctgctagcaatgtctcccacactgcggtcctgcgccctctcaaggctggttatttcaacttc

SEQ ID NO: 9260 - DNA, 450 bp, Homo sapiens
cctcccaaagacagcaatgggagaagtgaccccataactgcataaaataatccctcttctttgaagctcttggcaggaatcgctcagccagcaggaaacctttaacccaatacccagaaaaacagacatttggaggaagagggatcttccagattattcttccattctgccccatcctctacagagaaggaaactaagacacttttcaagaatcacaagataagttaatgatagaaagcagagtagaatcttgagtggaggagtgaaaataacattcactttgttcaaatcccagctctaccactttccaatggtgtgaacttgcacaaataactctgagtctcattttcttcatttgtaaaatggagagaacaatctccgcttcaagagattgtcttaaatggaacatgcaaagcatcactgatatcgtttaccaaccacacatagcag

SEQ ID NO: 9261 - DNA, 342 bp, Homo sapiens
aaacttttgagttgtagtcagaaactgttgttggactgcatagttttcaaaagtttttggtacatttctgactttagaaatctggggtaggaatccctttccatatgcatatagactattttctgagcttcttcaaaacatgtttcagtgggttcctgaatgttcctgatgatagtctctcttgtcgaactgtcaatgttaatctctctaggggactgtggctggatgtaaatcttataaagcttctttgccctagaaattccgctccaccgtgaggcaattttcttataggtttcacatgccatccagaattgaatattctcgtcactgtgctccattttt

SEQ ID NO: 9262 - DNA, 201 bp, Homo sapiens
cctctgtggatcccagtttgtcgtggggtcagaggaaaaaactttactatgacacggactatggttccaagtcccgaggccggcagagtcaacaggaggcagaggaggaggaaagagaggaggaggaggaggcacagatcattcagcggcgcctagcccaagcgctgcaagaggatgattttggtgtcgcctgggctgagg

SEQ ID NO: 9263 - DNA, 580 bp, Homo sapiens; identical to SEQ ID NO: 330

SEQ ID NO: 9264 - DNA, 318 bp, Homo sapiens
ctgccggcgccgggaaaggggctcacgtaccagggactctccattgaggtagatgaggtcgaaggcgtacaaacacacctgcacctggatctcagacgcatccacctccttgcgtttgcgggtggtgagcacttggaatggctggatctgcttcttttcccggtcccaagccacggcttcggtgtccaggatgaaggatgtgaccgatgggagtttaatcttggggatgcggctgatgatgtccgggtacttcccagtgttgtcttcctgattcctgctgaagatcttcacctccccgccttccagggcgtggatctg

SEQ ID NO: 9265 - DNA, 232 bp, Homo sapiens
cctgagatcagaggaaagcccccaatccgtgtttcacaggtactcacaagagaaaatgctaggagggttgtgccttgctaagggaaggaagaaaagttgggggtggggagcatgagatttgatgcagttagtaaagaatgaactctgaaaagtgttacgagagagagagagacttaaaacaaccatttgtttagctcatgactctatagattggcaattgagctgagttcag

SEQ ID NO: 9266 - DNA, 199 bp, Homo sapiens
aaaagaagaagaaaagctaccaaagctgaaatggtggcacctccttcgagtgagcccgggagtcctccctgacggccgaggcaggctctggccgcactcccgctcgagtctcccttcctgtctgcagattctgcgtgacagtcacggaacggcgtgatgggggcagcagagcgtgggggcctctgtccagcactcgtgg

SEQ ID NO: 9267 - DNA, 474 bp, Homo sapiens
ctgatgactttcttaatagaattgcattgacggatgcttaccttttatacacaccttcccaaattgccctgactgccattttatctagtgcctccagggctggaattactatggaaagttatttatcagagagtctgatgctgaaagagaacagaacttgcctgtcacagttactagatataatgaaaagcatgagaaacttagtaaagaagtatgaaccacccagatctgaagaagttgctgttctgaaacagaagttggagcgatgtcattctgctgagcttgcacttaacgtaatcacgaagaagaggaaaggctatgaagatgatgattacgtctcaaagaaatccaaacatgaggaggaagaatggactgatgacgacctggtagaatctctctaaccatttgaagttgatttctcaatgctaactaatcaagagaagtaggaagcatatcaaacgtttaactttattt

SEQ ID NO: 9268 - DNA, 260 bp, Homo sapiens
ctgtttccttctcttcctttgtggtgccattcccagggcacaggccatagctgtagttggggggcagtgggtatgggatgtgcccccggggcatcaggaggaaagtgcgtgctacatgccaggtactgcagacagagatgaagatgaaggaggccctgaggctgatgcctttttcataaagaagcttaataataaggaagactgccgaggaagagtcaaatgctccattgtacagagtgatgatggtcgaacggtgttgg

SEQ ID NO: 9269 - DNA, 136 bp, Homo sapiens
ccaaacagtgcccagcttaagcatccctggcatcagactatggccttcaagagcactagggcatatgcttttggcagcataacgggctggcttggtgatggagggaaaaagccttgagccaggcagaagtttgtgg

SEQ ID NO: 9270 - DNA, 251 bp, Homo sapiens
ccttcgtcagcctgcccagagaaggggagcagaacttcagtgcagaggagttctctgacatctctgagatgcgggccttggcagaactcctgggcccctatggcatgaagttcctgagtgaaaacctgatgtggcatgtgacctctcagattgtggagctgaagaagctggtggtggaaaacatggacatacttgttcagatcagatccaactttagcaagccggacttgatggcttccctgctgccccag

SEQ ID NO: 9271 - DNA, 356 bp, Homo sapiens
ctgctcggaaagctctggacagatgcagtgaaggctccttcctgctaaccacatttcctcgtcctgtgactgtggagcccatggaccagttagatgatgaagagggacttccagagaagctggttataaaaaaccagcaatttcacaaggaacgagagcagccacccagatttgcacagcctggctcctttgagtatgaatatgccatgcgctggaaggcactcattgagatggagaagcagcagcaggaccaagtggaccgcaacatcaaggaggctcgtgagaagctggagatggagatggaagctgcacgccatgagcaccaggtcatgctaatgagacagggtgagtctagg

SEQ ID NO: 9272 - DNA, 406 bp, Homo sapiens
ccaggctggtctcgaactcctgatctcatgatccgtctgcctcggcctcccagagtgctgggattacaggcatgagccactgcgcccggccaagaaagtatgtttttagaggtgtgtgtaagtgcatttgtattacctatgaacaaaattacctgactcttgtcccaggaaagctgtttcgcattttcgctttttgattggtattatccagttctatgtagttcatattattgttctgtctgactctcagaaattacttcttcacgccagtgtcttgttgcatgactttgatgtcacctataggaatacacctcactgcacgtaagtgggtatcttactgtataaaaggtctacatggctttaggttttaggacaaatgtgtagatttatagaccatttctgctgg

SEQ ID NO: 9273 - DNA, 306 bp, Homo sapiens
  misc_feature (1)...(306): n = g, a, c or t
ccttgcctcanatccaaggtcactcggaagaggccatgtctaccctcaatgacactcatggaggaaatgctgagagaagcattcagatgcatgacacaagagccaatgaaaggccctattgctatgcaatctggtccaaaaccactcttcaggaggatgtcttcactggtgggccccacgcaaagcttcttcatgagggaatctaagactttgggggctgtccagattatgaatgggctcttccacattgccctggggggtcttctgatgatcccancanggatctatgcacccatntgtntgact

SEQ ID NO: 9274 - DNA, 243 bp, Homo sapiens
ctgtggcttagctggctttgctggtcgtaatggaggacaaaagtgccttctggtgaaactcagcttccatagtgatgggacctaagggtagcagagtttatggtgaccctgtagtgtatctccagaaatggtgattgtttgaatgcatgtaagacattccctagggactccaagaaatattgattagaggaagatgtggtgctttgaaagggacttggtgttcctacatgaaccaagtgaagg

SEQ ID NO: 9275 - DNA, 548 bp, Homo sapiens
aaataaaattcagtccggccgcggtggctcatgcctgtaatcccagcactttgggaggccaaggcagacagattatctgaggtcaggagttcgagaccagcatggtcaacatggtgataccccatgtctactaaaaatacaaaaaaataaaaattagccaggtatggtggtgggtgcctgtaatctcagatacttgggaagctgaggcaggagaatcacttgaaccagggaggcgaaggttgcagtgagccgagattgcaccattgcactccagcctgggcaacaagaacgaaactccgtctcaaaaaaaaaaataggccaggcgtggtggctcatgcctgcaattccagcactctgggaggccgaggcgggcggatcaagaggtcaggagatcgagaccatcctggctaaaccccatctctactaaaaaacaaaaaaaatcagccagacgcggtggcgggtgcctgcagtcccagccactccagaggctgaggcgggagaatggcatgaacccaggaggtggaggttgtagtgagccaaaatcgcgc

SEQ ID NO: 9276 - DNA, 333 bp, Homo sapiens
aaaaaaaacaacagcgtaaatattagcccacaagagcagtcctaaacaatcacaattacactgtactacccaagaagactgtttattgtgaagcatttacctttcaaaaaatcattacatttctatttcttggtggagcagcacattgtggagtgtgattcttaattcttcattgagtttgtcaataggacattgatgctggataggttgtcttttgtttttatgtctcagaccatcttgtgagattgtttgcctatctcataatacagttttatgcagaaaggttgaaactatgtaaatggtttttatggaaattatcagttacaacatttt

SEQ ID NO: 9277 - DNA, 157 bp, Homo sapiens
aaaacatcgcgctaagtggacgaattcagacacaaccgtctacgtgttgtatggctgcattcacgttcaagtcaagtccaaatagggcacactgcagagacaaagccaggtcatggttgctcaggaccggaagcctgttgggggcggggggtggggt

SEQ ID NO: 9278 - DNA, 252 bp, Homo sapiens; identical to SEQ ID NO: 151

SEQ ID NO: 9279 - DNA, 546 bp, Homo sapiens
ctggagagattgttgaagcagatgttgccattgggaaaggcgatgagactccacttacaaatgtgaagacagaggcatcccctgaaagcatgttgtctccatcacatggctcaaatcccattgaagatcctttagaggcagagactcagcacaagtttgaaatgtcaggatgccccaggtgaggatgaggaggaagatggtgtcagtgaagcggccagcctagaggagcctaaggaagaggatcaaggagaaggctacttgtcagaaatggataatgaacctcctgtgagcgagagtgatgatggcttcagcatacacaatgctacactgcagtcacacacactggcagactccatccccagcagccctgcttcttcacagttctctgtctgtagtgaggatcaggaagctattcaggcacagaaaatttggaagaaagccatcatgcttgtatggagagctgcagctaatcataggtatgccaatgtcttcctgcagcctgttacagatgacatagcacctggctaccacagcattgtgcagagg

SEQ ID NO: 9280 - DNA, 346 bp, Homo sapiens
aaaatgtctttgagtctgtccctttctctctgttcccactgcccctgctcaatactgtcatttgattagactattgtataagcctctcttatgaactgaatatttttgtcttccccaaattcatgttgaagctgtcactcccaatgtgacggtatttggaggtaaagcctctgggaggtaattggtttagatgaggtcatgaggatggggcctccatgatgggattagtgcccttgtaagaaagtggaagagagaccagagttctttatctccaccgtgtaaggccacagcaagaaggaggccgtctccaagccaggaagagagccctcccagggaactcactcag

SEQ ID NO: 9281 - DNA, 539 bp, Homo sapiens; identical to SEQ ID NO: 551

SEQ ID NO: 9282 - DNA, 459 bp, Homo sapiens
gtgttgtgctgtggggaagggagaaggatttgtaaaccccggagcgaggttctgcttacccgaggccgctgctgtgcggagacccccgggtgaagccaccgtcatcatgtctgaccaggaggcaaaaccttcaactgaggacttgggggataagaaggaaggtgaatatattaaactcaaagtcattggacaggatagcagtgagattcacttcaaagtgaaaatgacaacacatctcaagaaactcaaagaatcatactgtcaaagacagggtgttccaatgaattcactcaggtttctctttgagggtcagagaattgctgataatcatactccaaaagaactgggaatggaggaagaagatgtgattgaagtttatcaggaacaaacggggggtcattcaacagtttagatattctttttattttttttcttttccctcaatccttttttattttt

SEQ ID NO: 9283 - DNA, 113 bp, Homo sapiens
ccagcttcttcagcaaggtcatgggcatcctcatcaaccgcaagacagaccagctcgtgtcctttcttcggaagaaggatgacttcgtggacctgctgctgcagcacattggc

SEQ ID NO: 9284 - DNA, 179 bp, Homo sapiens
  misc_feature (1)...(179): n = g, a, c or t
gttttaaggcgccatgaggggtgacagaggccgtggtcgtggtgggcgctttggttccagaggaggcccangaggagggttcaggccctttgtaccacatatcccatttgacttctatttgtgtgaaatggcctttccccgggtcaagccagcacctgatgaaacttncttcagtgagg

SEQ ID NO: 9285 - DNA, 542 bp, Homo sapiens; identical to SEQ ID NO: 331
  misc_feature (1)...(542): n = g, a, c or t

SEQ ID NO: 9286 - DNA, 484 bp, Homo sapiens
  misc_feature (1)...(484): n = g, a, c or t
ccattggaatctcatttataaatggaccttttaagtatattaattcctcttcagaattgagctggacacatttggcattcttagtttgtcatataaccaggtttatccttagtctaactgcaagggatagaacctgccctaggtcacaatcattctgtccaatccagccaaggttccctccacatatgaagatggaccatggcaggatacaactgattgtgtggcaccatgtattagcagtgggaatatgtatcacatatgatgcagcctttcatatttcagcagtttgccactgtgactgtctggcaagcccccagatggcgttatattaattggattagattattttgctcaccttatgtaatactgtaacttcctataacctaatattttcggtatcattaaccaaaatttcacactcatagnttgctaaagagaatgttattcaatcattaaactctgaactgatttcttctatacattt

SEQ ID NO: 9287 - DNA, 502 bp, Homo sapiens
ctggatgacctggggcaagccgcttccccactctgtgcctcagcttttcatcagcaaagtagagataaaaacagcatccacctcactgggctgctgtgaggattatcggagcttgtatttgtgctcggcacaggtaagcaccagttaaagaaactgggtaacaggacaaatgcttatctacacagacaagactcctgaagttataaaccacagactatggtctacacagctcatatcaggtgctgtgcccagggcttgggacctaccagcacatttaaccctgtaaggtagattattattatacccattttccaggtaaggaaactgaggcatggatttacatagaggtgggggcggggctggacagaggtaccaaagctcacagcttctagaaggatgttctgtgcatgaggcagtggctatgaccctgctggactaattcaaggacatgctctccccaaattgtgcctctgcatctcaccgagatggctcagttctgtgc

SEQ ID NO: 9288 - DNA, 375 bp, Homo sapiens
  misc_feature (1)...(375): n = g, a, c or t
ctgatgcctcactactagatgcagngctgggaccttcctcttttggagctgtcccatgtacagtggacccaagctcaggaccttcgtggagctgcttctccaacctgagaaactcaagacccatcctcccgctgtcactttggacaatggaaatctacattttcttttcccttttttttttnttttgagacagantctcgccctgncacccaggctggagtccagtggcncaatcttggctcactgcaacctctgcttcccgagttcaagcaattctcctgcctcagcctcctgantagctgggattataggcatgcaccaccacacccagctattttttgtatttttactgnagacagggttncaccatgttgg

SEQ ID NO: 9289 - DNA, 337 bp, Homo sapiens
  misc_feature (1)...(337): n = g, a, c or t
ccaagggtaggggcggggcggggaagtgaaccccgacggtcagcgctttgtcatctggtttcagccccgctgccgtgcacggngggactggagcaagtcgctcacctgaaatgagtatgagcagaccttccctgggttacgaattgagatgggatgaaaatgctttaacttcgagtgttttgaaggattaaataaccgaagtacaaagtagtagtagcggagacagtaaggaagtcgggcgtggcggcgcgcacctgtggtcccagctactcggaaggctgaggggggaggatcacttgagcccaggagttcgaagctgcagtgagctgtgatgtgg

SEQ ID NO: 9290 - DNA, 316 bp, Homo sapiens
ctggaatgttgttggaggtctggtctccttccttggggaaagtgattttggttccttctttccaccccttcttcacttcgatggtcaatattttgtcttcgtttcgaatgctctttccgtcggggtttagccgcttgtgggagattttcatcttcttggtacagccgctgtagatctcttcaagggagactcgaaggtcgtgggtgactgggggatcttgcttctttcgggcgggctcttgggcagagcgggagcggccaaagttcacgttggtgaagccacccatgcccatagggaagccagagaatgggtcatc

SEQ ID NO: 9291 - DNA, 287 bp, Homo sapiens
cctccacccaggtgccacgcacggtgcctcatacccagagagtagccaacattggtactcagaccacaggacccagtggggtaggatgctgtacaccaggccggccgctcctgccgtgcaaatgttcctcagcagcacatagcacctatcgggtccaggagccggctgtgcacatcccaggacaggagcccctgaccgcgtccatgctggctgcggcgcccctgcatgagcaaaagcagatgattggggagcgtctctacccccttatccatgatgtccacacccag

SEQ ID NO: 9292 - DNA, 380 bp, Homo sapiens
aaaaaatcttaggtttttttaagaagcagaaataatttccaaattgcctccagagacaatgattttatcctctgcagaagctggtcagaaccttcttgatcacagccccagttagatacagggaagaatggcgcttcctacagcttcagcggcctcagctcagctctgtgccccaaggccaaaccagctcatctccagccccatccatcctattcttgctgagtcaccagtctcatcatcttcagagccatgtccccttggtcagaaggaaccatatgaccagctttcagaatccagtagaaagcaaggttcttgtaggacttgacaaaagcagatgtttccaaagatttagggtcactgtacagggccttccacttcag

SEQ ID NO: 9293 - DNA, 366 bp, Homo sapiens
ctgcagggcgaaccgctgcttcctattggtgtccaccacgcgctgcacatcttcagcagagaagccgcggaactggggcaactgcaggagggtgcccaggggcacgaagccatctgtgggcaggcagggtgctcaggagctaaccttgctctggactgggccagggttaacagggagccacaggcaaccgaaacaaagtctgggcttggagatcgcttgggcatcctctgtgggacctttagaaagtctcccctttctgggccgcagttttttcaacttacataaaaagaggatctgcctcacggaggggcagggaggtgagtgcccagcatagcgctggcccggagtgcacactcacaccaccag

SEQ ID NO: 9294 - DNA, 333 bp, Homo sapiens
aaacttatctgtttgtaaattgtaactgattaagaattgtgatagttcagcttgaatgtctcttagagggtgggcttttgttgatgagggaggggaaactttttttttctatagacttttttcagataacatcttctgagtcataaccagcctggcagtatgatggcctagatgcagagaaaacagctccttggtgaattgataagtaaaggcagaaaagattatatgtcatacctccattggggaataagcataaccctgagattcttactactgatgagaacattatctgcatatgccaaaaaattttaagcaaatgaaagctaccaattt

SEQ ID NO: 9295 - DNA, 347 bp, Homo sapiens
aaagctgtccatttatcttgatgcctaaaagttgggagatgctataaagacgatgacatttctaaactggactacactgtttctggaaactgttaagctgagtccagtacttttaagcctgacagtatctgaggatcctaatatggtgctaagccttcaggggtggagcggggaaagagtattaaaaaaggagtgttaaaaaatccctccaaaattcaggaatcagcatcataaatttaaccattcaaaatgtggtattatagaaaccaaaacattcattttgaccaaagaaaatctgtgagtcatttcctaagcctgggaaacaagccacaggatatagtgacttt

SEQ ID NO: 9296 - DNA, 297 bp, Homo sapiens
ccagctctcgagtgggggtgatgattatggctccaacctgactcttttttaacttctcttctcttctcagaagaatttccaggatggggatgacaaaagcgagtgttttgccactacctgtgacccgaggcactcaccgcttctgcagcgacatctttgtttcgcatgaacagagggatggttgcggactgcaccggcgtcatgtacgggaagcccagctcccgcagcgcgcccagcacctgcgggtgcagcggcacaggcagcgactcccaggagccctctgtcacatgctccatg

SEQ ID NO: 9297 - DNA, 247 bp, Homo sapiens
ctgctatttctgcttcagcgaaagccacgatcccagcacacaggcatgcgctactgtgaggtcaggacgaggaaaagagccaggccctttcacccagatcgcggcggcccagcaggacttgcccggagtgtctcatgcagacttttgtgtgtgtgaagaaaagctttttgtcttgctctgggcaccctgaggccaaatatataatacttacatccagccccaaagcccccagtctgtctccactttt

SEQ ID NO: 9298 - DNA, 234 bp, Homo sapiens
  misc_feature (1)...(234): n = g, a, c or t
aaaaacaaaaagagggaatggatgcagaagcccgtctgggctttccgtggagtcgccccttcccaatggcgatggccgctccctgtggcctcagcttcctccgtggaatgaaggggtccaggtgacaccttcctcgaagggtgggcgtgggcctaaggctcccaagtcggccaggggctcggcctggctcanaagaggtgcttcacatcaacagtggtacggggtggccgctgg

SEQ ID NO: 9299 - DNA, 282 bp, Homo sapiens
ctgcagtccctagatctctgcctccgaacttgtgcttctcagaaccccctgagcccctctgggccttgcccctgtcctacatagctttcacaccgaatttatggattggtcccttagtaaccctctaagccttgctcacagttcttaaaaccgtctatctccttccaggctctgtgaagctggtgaccccggaggggtccccagtccggggacttcgcacacctgagatccccatgaccgaagcggtggaggccgtggctatggttggaggtcagcttcagg

SEQ ID NO: 9300 - DNA, 392 bp, Homo sapiens
aaacaccctgagatatgcagacagggtcaaggagctgagcccccacagtgggcccagtggagagcagttgattcaaatggaaacagaagagatggaagcctgctctaacggggcgctgattccaggcaatttatccaaggaagaggaggaactgtcttcccagatgtccagctttaacgaagccatgactcagatcagggagctggaggagaaggctatggaagagctcaaggagatcatacagcaaggaccagactggcttgagctctctgagatgaccgagcagccagactatgacctggagacctttgtgaacaaagcggaatctgctctggcccagcaagccaagcatttctcagccctgcgagatgtcatcaaggccttgcgcctgg

SEQ ID NO: 9301 - DNA, 404 bp, Homo sapiens
ggcggagaagctggagtgactctagggcagccgcatctttcgcgtcaggatctcaccaccttggatgttaccaagttgacgccactttcacatgaagttatcagcagacaagccacaattaacataggtacaattggtcatgtagctcatgggaaatccacagtcgtcaaagctatttctggagttcatactgtcaggttcaaaaatgaactagaaagaaatattacaatcaagcttggatatgctaatgctaagatttataagcttgatgacccaagttgccctcggccagaatgttatagatcttgtgggagcagtacacctgacgagtttcctacggacattccagggaccaaagggaacttcaaattagtcagacatgtttcctttgttgactgtcctgg

SEQ ID NO: 9302 - DNA, 197 bp, Homo sapiens
ccatcgtgcctctttgggcttccatgggcaactacatcaccaggatggcgcagaagtaccatgagtactcccactacaaggagcaggatgggcaggggatgaagcagcggcctccgcggggctcccacgcgccctatctcctggtcttccaagccatcttctacagcttcttccatctgagcttcgcctgcgcccag

SEQ ID NO: 9303 - DNA, 167 bp, Homo sapiens
ctgcgaatcggggagcccatgtattgacttagtgcggtagcatgcagccctcggcacggagggtcagtccccgctgttcttaaattagggtaaatggcgttggtgtccgtatttacagacttgaaatgtatcaatcctgagcagttccgatgtaaatccgagaccag

SEQ ID NO: 9304 - DNA, 243 bp, Homo sapiens; identical to SEQ ID NO: 622

SEQ ID NO: 9305 - DNA, 499 bp, Homo sapiens; identical to SEQ ID NO: 152
  misc_feature (1)...(499): n = g, a, c or t

SEQ ID NO: 9306 - DNA, 293 bp, Homo sapiens
cctggcctcacatgacccctgctccagcaacttgaacaggacaagcagcagctacatccttaaggtcgggaaagtaagatgaggatttggatcctgcattgccctgcctcccaccctatctctccccaaattataaacagccatccttgggaagcagcagagttaagacgtctccccactgccctagtgacatacacaccaacaggagagcatgttcagatggcacagaatccagggactgcatttcatgaggagaaactggtaccaaaatatgggtggggagtcggggggtg

SEQ ID NO: 9307 - DNA, 468 bp, Homo sapiens
ggcggccggtgagggggaagcaagtctggtctctgtgattgaagaagtcggctctgggctccagtgcgggaatcacacacatacctcagaatgccgggtctaagttgtagattttatcaacacaaatttcctgaggtggaagatgtagtgatggtgaatgtcagatccattgctgaaatgggggcttatgtcagcttgctggaatacaacaacattgaaggcatgattcttcttagtgaattatccagaaggcgtatccgttctatcaacaaactcatccgaattggcaggaatgagtgtgtggttgtcattagggtggacaaagaaaaaggatatattgatttgtcaaaaagaagagtttctccagaggaagcaatcaaatgtgaagacaaattcacaaaatccaaaactgtttatagcattcttcgtcatgttgctgaggtgttagaatacaccaaggatgagcag

SEQ ID NO: 9308 - DNA, 545 bp, Homo sapiens
  misc_feature (1)...(545): n = g, a, c or t
ccagcaaaaaggagcgttttctccaggtgcagtccatgatgtacgatctgatggagtggaggtcccagcttctctcaggaaccttacccaaggatgagctgaaggaactgaagcagaaagtcacgtccaaaattgactatggcaacaaaatccttgagcttgatttgattgtcagagatgaagacggaaatatcttggaccctgataataccagtgtcatcagcttgttccatgcacatgaggaagcaactgataaaatcacagagcgtatcaaagaagaaatgtcaaaagaccagccagattatgcaatgtattcccggatctcctcatcccccacccatagcctctatgtgtttgtgagaaactttgtgtgcagaattggggaagatgctgagctcttcatgtctctctacgaccccaacaagcaaacggtcataagtgagaactacctantgcgatggggcagccggggcttccctaaggagattgagatgctcaacaatctgaaggnggtcttcacggatcttggaaacaaagacctcaac

SEQ ID NO: 9309 - DNA, 342 bp, Homo sapiens
  misc_feature (1)...(342): n = g, a, c or t
aaacttttgagttgtagtcagaaactgttgttggactgcatagttttcaaaagtttttggtacatttctgactttagaaatctggggtaggaatccctttccatatgcatatagactattttctgagcttcttcaaaacatgtttcagtgggttcctgaatgttcctgatgatagtctctcttgtcnaactgtcaatgttaatctctctaggggactgtggctggatgtaaatcttataaagcttctttgccctagaaattctgctccaccgtgaggcaattttcttataggtttcacatgccatccanaattgaatattctcgtcactgtgctccattttt

SEQ ID NO: 9310 - DNA, 356 bp, Homo sapiens
aaaaattagtctgtactcaaatgcatagttaaaaaaatgaagcgagatggcagtttgtgcagtaatatctgcccttcgaagttcatgcaaccaactaatgcaatttttcctttcactcgtaaatctgaatgcagttcagtcatttgaaaccatctacaaaatccacaagattaagcagtttgccaagattaatatctaacagttgagcactggagaaagtgagggaaaggagtaaaaacaaacaacgaaaaagaccaagttagctagatatttcaactacataagggaggtgggtgaatgtcaaggctacaaaaacgaaacaaaaacaggaaaaaaaagtggcagcaatttttttt

SEQ ID NO: 9311 - DNA, 243 bp, Homo sapiens; identical to SEQ ID NO: 154
  misc_feature (1)...(243): n = g, a, c or t

SEQ ID NO: 9312 - DNA, 328 bp, Homo sapiens
aaaaagatccaaatgtgactgagatcattccagcctgcactttttatttgtaggcagaaggaacgggataggttgaggggcgtgatgggggctctcgccacctcttgtctgcacctctggaacaggtggtagccgaatcattcaagtcctacctggtcagactcccaaccacgctgaggcaggcccttacctggatggcctcatgggcctccctcttgaaaagaccctcactctgtttggaaaagatcccttagcagccataatcaggaaagagactctagagcgagcccagggcttccccaaagcggattttctgtcctgttttcag

SEQ ID NO: 9313 - DNA, 313 bp, Homo sapiens
cctcggtggggccgggcaggcagggcgggagctagcctgcaagagaaacagccccaatgctgggtaagagagcagttcaccccatccccccctccacgaccctggcgcccgccctgtacctgaaggcgcccgggttctgctgcagcgcatctggtaccatgtcttcattctcctcctggcagagggagcacatggagtagacgagccgctgcagggaagggaaagtgagcgcgtggcacagggctcgctgctggaaccctgccagggcatgcagacgcaccgggctaggtgtccctgccccgggatcctccag

SEQ ID NO: 9314 - DNA, 430 bp, Homo sapiens
  misc_feature (1)...(430): n = g, a, c or t
ccaacatggggaaaccccatctctactaaaaatacaaaaattagccgggcgtggtggagcacctgcagtcctagctactcaggaggctgaggctggagaatcgcttgagcccggaaggtggaggtgcagtgagccaagatggcgccactgcactccagcctgggcaacaaccacaactgaaaaaaaatctactgaggccagagtgagttggggcggggagcatggagagggggtcaggcttagccccaacaactcagaatttcacttccttgtacggccctcactttctccacctggccccggggcaggtctgagggtctgaagtctgttgatctgaaggtcctaggcaaatccagtcacttgggagccggagatatttaacatcacggcccggncccctttcccangggactcatttcctagcactctc

SEQ ID NO: 9315 - DNA, 310 bp, Homo sapiens
ccggcctgcagaccgactgcgaggcgctgctcagccgcttccaggagacggacagtgtacgcttcgaggacttcacggagctctggagaaacatgaagttcgggactatcttctgtggcagaatgagaaatttagaaaagaacatgtttacaaaagaagctttagctttggcttggcgatattttttacctccatacaccttccagatcagagttggtgctttgtatctgctatatggattatataatacccaactgtgtcaaccaaaacaaaagatcagagttgccctgaaggattgggatgaagtttt

SEQ ID NO: 9316 - DNA, 209 bp, Homo sapiens
  misc_feature (1)...(209): n = g, a, c or t
cttttttttttttttttttttgacctggagtctcgctctgtcacgaggctggagtgcagtggagcgatctctgctcactgcaacttctgcctcccgggttcaaacaattctcctgcctcagcctcccaagtagctgggactacaggcgcgtgtcaccatgcctggctaatttttgtatgtttagtananacggggtttcaccatgttgg

SEQ ID NO: 9317 - DNA, 435 bp, Homo sapiens
ctggattaaggacatgatcttgaacttccagacatctgaatttcagtacacactggatttaggtacctaatgggtggtcctggacacactgtgtacacgtaaaagagaaactgtggggaaaaatgtagaaaacagaaaggagccaccaaaaatccatgagtggaggacagtaaaaggtaggtggacagactggtttgtgttaaagataatggtctagaaggggctatactcagaattattcctgtgtccgtgcaggcagttgagattattaacaggtggtggagagaacaggttgctgttgcagattcagtgtctgagggtagaattatactaggagacctataggcacttgtgtaggtttttggcaagaaactagaaaagaaggcactgtgatgggattcctaagggtggtacttactcctgggaggggcatgg

SEQ ID NO: 9318 - DNA, 373 bp, Homo sapiens; identical to SEQ ID NO: 90

SEQ ID NO: 9319 - DNA, 175 bp, Homo sapiens
ccagagggaccgtaagactggtacaagtttacaccataagaggcgacgtggtcagccacaatgtcttcacctccacaggggctcatcacggtggtcagggcaagggtccccagcatcagagctttgtttaggatcatcctcttcccaaggcagccttagcagttgctgttctgag

SEQ ID NO: 9320 - DNA, 173 bp, Homo sapiens
ctggcttgcctgctggcctgcttcctggagataggatgctcagacccaccgccgctcttcaggggtcgtggaaggaattaatgcacttccttctgtcccccaatctctgtccctttacgtgtctctggagctgagcaggtattctttttctttcttcatctcagtagagctgg

SEQ ID NO: 9321 - DNA, 353 bp, Homo sapiens; identical to SEQ ID NO: 327

SEQ ID NO: 9322 - DNA, 284 bp, Homo sapiens
aaaaatacagttccccaggttgaggtatgtggtggcctgttgtcacggcagcatgagcacggcggcgcccagggcgggggcggaagggcctagctggagactgccatcacgtagttcttggaggggctgctccggcccagcagcacttggttcttgcaggtgaggagcccacaggaggcggccagtggggcctcctcgtacaagacgcagatggagccgtcctccccaatgcggtaggacacctcataggggtccacccacagggtcagctcgctgggcagcag

SEQ ID NO: 9323 - DNA, 356 bp, Homo sapiens
aaaaaaaattgctgccacttttttttcctgtttttgtttcgtttttgtagccttgacattcacccacctcccttatgtagttgaaatatctagctaacttggtctttttcgttgtttgtttttactcctttccctcactttctccagtgctcaactgttagatattaatcttggcaaactgcttaatcttgtggattttgtagatggtttcaaatgactgaactgcattcagatttacgagtgaaaggaaaaattgcattagttggttgcatgaacttcgaagggcagatattactgcacaaactgccatctcgcttcatttttttaactatgcatttgagtacagactaattttt

SEQ ID NO: 9324 - DNA, 475 bp, Homo sapiens
ctgcggcgactgcggggcccagccaagtgccgcgagtgcgaagccttcatggtcagcgggacggagtgtgaggagtgctttctgacctgccacaagcgctgcctggagactctcctgatcctctgtggacacaggcggctcccagcccggacacccctttttggggttgacttcctgcagctacccagggacttcccggaggaggtaccctttgtggtcacgaagtgcacggctgagatagaacaccgtgccctggatgtgcagggcatttaccgggtcagcgggtcccgggtccgtgtggagcggctgtgccaggctttcgagaatggccgagcgttggtggagctgtcggggaactcgcctcatgacgtctcgagtgtcctcaagcgatttcttcaggagctcaccgagcccgtgatccccttccacctctacgacgccttcatctctctggctaagaccttgcatgcagacc

SEQ ID NO: 9325 - DNA, 314 bp, Homo sapiens
ctgtatatgggttcagattagaaaatattaaataaatacagggaaaaatatttttaattagcttaatttatatatgaagatattttatttaatttgtttttgagacagggtctttctctgtcacccagactggtgtgcaatggcacaaacacatctcattgcggcctggacctcctggcctcaggtactatgcctagctaattttttttattttttgtagagatgcattctcactatgttgcccaggctggtcttgaactcctggcctcaagtgatcctcccgtctttaccttccaaagggttgggattacagg

SEQ ID NO: 9326 - DNA, 545 bp, Homo sapiens
aaacaaacctaaaatcagtttaacctgcaatgagactttggaaccagctacagtccttaaaacagatgccagaaattgctcatgtggtgacagaaactgcagaataggtgaaatgcttgctgtttcctcatatgctcaggttggcatcttgagcttccatggggtttcggtgcccctcaaaaaacctggacctgcaattctggaatgctgccaccaggggaaggtatggcttgatcacttgccagatttatagaaggctcaggtaagtactgcagctcctggggataactgccttggagtagagagaaactgttgagaaatcatggatccagataactccaaaaaaagagtaatgtgcctgtccatgcatcacccttacatacagacatggagacatttacagagtgagtgaatcacagccacatccaggtagatggcaagaacccaagcctatcatcagccacagtccagggaatttctgtgaagaatgggcatacctgccttcctttgtaaataattctcttcttccacttaaatcgttattt

SEQ ID NO: 9327 - DNA, 307 bp, Homo sapiens; identical to SEQ ID NO: 155
  misc_feature (1)...(307): n = g, a, c or t

SEQ ID NO: 9328 - DNA, 425 bp, Homo sapiens
aaaaagaagaggaggaggagcgaggactctgaagaagaagaactagccagtactccccccagctcagaggactcagcgtcaggatccgatgagtagaaacggaggaaggttctctttgcgcttgccttctcacaccccccgactccccacccatattttggtaccagtttctcctcatgaaatgcagtccctggattctgtgccatctgaacatgctctcctgttggtgtgtatgtcactagggcagtggggagacgtcttaactctgctgcttcccaaggatggctgtttataatttggggagagatagggtgggaggcagggcaatgcaggatccaaatcctcatcttactttcccgaccttaaggatgtagctgctgcttgtcctgttcaagttgctggagcaggggtcatgtgaggccagg

SEQ ID NO: 9329 - DNA, 345 bp, Homo sapiens; identical to SEQ ID NO: 332

SEQ ID NO: 9330 - DNA, 462 bp, Homo sapiens
ctgagaggccaccagtgaggctgggccttatcttccccgccccacccctccccctctcaggctgtgccagcctcaggcaggccctgtgcatctctgggccagtctcaaatccttactgaatggctagatctgtgtacttcaggtctgtctttctgtttcttccactatttctacggctcataagtctctgtctcttctttcagggcgtctatttctttctcttgttctctctttttcccgtgtgtttccctttggagctgtttatgcctgtctcccttggtccaggtcggtgtgtctttctattaatttattttttgagacagggtctcactctgtcacccaggctgagtgcatggctcactgtagcctcaaactccctggctcaagtgatcctcccacctcgacctcccaagtagctgggaccccaggtgcacaccatcacacccggatttttttttacct

SEQ ID NO: 9331 - DNA, 127 bp, Homo sapiens
aaatccagaagacaaacctagaaaagcagcaagataaatatttacaaacattgtagaaaaacagcagtatttcaagttttgttaaattctttccttcagacataatgtagacatagaggaggaacag

SEQ ID NO: 9332 - DNA, 550 bp, Homo sapiens
aaatatcacaagtaggtcttaagtgtcatctggcatcttctttctgtagccaggtaactcttagatcttattcatcagcctgctgaacagttcctttttcagagacatagataccatccaaaaatttcctgatatccttgtttttaactgttgtggcttgctgaatcaaagccgctgaatttgaaacaagctcaatgtcatttccttcaaggattaattcatctttctgggcttgagatactgaacaagcaacacctggtctcatccgaaccctgcggatgtatttttcacccaagaaatttcggatttcaacaagagacccattctcctggataacaacgttgatggggaagtgagcatacacagacctcatcttgtaacggaagcccagtgtaacacccttgatcatgttctgtacatgactacaaatagtccgaacggtagccagtttctttctgttaccccaccatttgtcaacccggagcctcttttttttctttccaagaaggctgagttctacattgatgtgattgaagtccctccgcaacct

SEQ ID NO: 9333 - DNA, 507 bp, Homo sapiens
ccacggagcccaatcctggcacaatgtggaggaggatatgaatcccaggaggcagggatgactgcaggcatcttggaggctgactaccaaccatggataggtaaatgagtgccaggagttaggagatcacacctcggtagagagagttccttgagccaggaagactatgcacaggctcaggaaggctggctgggcctaaacagaagtgggtcaaaggttaaggagtatgtctcagtctatttgggctgccatagcaaaatgccatagactgggtaactcataaatagcagaaactgattcctcacagttctggaggctgggaagtccaagatcaagttactggcagattgggtgtctggtgggggtccattcctcatagatggcatcttcttgctgagtactcaacatgacaggaggggtgaacaagctccctgaggtctcttttatatgggtactaatcccatccataaaggctctgccttcaagacctcgtcaccttcccaaagg

SEQ ID NO: 9334 - DNA, 437 bp, Homo sapiens
aaaggcacttatttatcattgtaggtgtgtctaaacaattgatattcaaaaacacaactttttgtgtacaaaattttacaatttttaacaaaagcagtgaagacactaaataacccagtggcgacctcttcaaagtgcagtgtccctggtcaccaatgcagatgctactggggcagccagcgggctcagagggtccaactccagacactgcatccatggctgtcctagactgagttgcacttgtaaaagagatggtcccacacctactaaaaaaacaagctactctagtatcaatatgacatcactcttttaccatcaatcatattgcaaaaccatagtatttaacgaccaataaacagccaaatacctaatgccacattgtcgttcaatttacctggctggttaatatcagtctgtgtttgagtatttcttttgag

SEQ ID NO: 9335 - DNA, 358 bp, Homo sapiens
aaaagctccaaccagctcatgccagctttccagagtcccatgatttccatttaagaccatgtggatactttaggatacggccctgaccccacattgccacagaagagggggtaagagtagaaccaaacaagttagcagttttctccacacattgagtctcatctgaaatactactgaggtgcaaaatgtgtgaatctcagctaatgtgcacagaaatacaattttttttgagagacatttgcttaaacgtggtaaagaactcttgttttatggactccttgcttcatgttcattttgtctgtttttcttttggcttttgacaatagctcatcctttttgagtgtgagtttaattatgg

SEQ ID NO: 9336 - DNA, 236 bp, Homo sapiens
catggaggtcatgtcttttcactgatacttttttgatagtttttatataacaaaatccttactctatttataacttaagatgataaggcactataaattaatgacctaaaataatatatttgtctgttatcttttgctatttctacttcactttaatttttagctgtaaaattggtaaatggattcttacaactatctctttccatttcttactatttggttttcaaatttcattt

SEQ ID NO: 9337 - DNA, 502 bp, Homo sapiens; identical to SEQ ID NO: 156

SEQ ID NO: 9338 - DNA, 86 bp, Homo sapiens
ctgacctgcttgaccgaaggatttctgacagactatctttggggatgttttcaagaagggatataagttatttactttgggcattt

SEQ ID NO: 9339 - DNA, 456 bp, Homo sapiens
cctctgcgattttgaaggacaactgctgctaaggagtctatctgtgattggagggttgaaacagtattaggtaagtcttccaaactgtttgtaagatcttgtgagagggagcaatagtacatgagggaagtagaaagcccgaccactccggttccaactgcagtagtcattcctagtcgtactaggatgggtattaactgaacggccctgcattggcacacttgagtttttacagggataggtaggttttgcttcctgggacaatgtcgatttttgggcttagaaaaaccagagtacaggtaccagtccagttgatagggtagcagaggtaggtggaggtaccgcacaggaagaatatgccttggctaggtaagtaaaattggttgtgtatgttaaaaagatgtgtaagcttgtggtctttgtatatccatgctcctagggtgcttgctaaggcag

SEQ ID NO: 9340 - DNA, 542 bp, Homo sapiens; identical to SEQ ID NO: 333

SEQ ID NO: 9341 - DNA, 538 bp, Homo sapiens; identical to SEQ ID NO: 157
  misc_feature (1)...(538): n = g, a, c or t

SEQ ID NO: 9342 - DNA, 323 bp, Homo sapiens
ctgtaagggccatttgaaagtttggaattttaagtgtctgtggaaaatgttttgtccttcacctgaattacatttcaattttgtgaaacactcttttgtctacaaaatgcttctagtccaggaggcacaaccaagaactgggattaatgaagcattttgtttcatttacacaaatagtgatttacttttggagatccttgtcagttttattttctatttgatgaagtaagactgtggactcaatccagagccagatagtagggggaagccacagcatttccttttaactcagttcaatttttgtagtgagactgagcagtttt

SEQ ID NO: 9343 - DNA, 298 bp, Homo sapiens
aaattaaatagctccagacaaaagcatgttattttccacatacgctatctttgtattctgcacagagttccaaggcaaagattgctcctggctttatgaattaccagagatgatgacttgtgtggctgacttatcacaggtcttttactcttccttcctgatagatccttagcttctttgggaggtggcatatgaattggtttccacggaattggattataaaaggctggttctggataggaatttccactgtaaaaacctgtaagttttccattggcataaccatagctctttgcag

SEQ ID NO: 9344 - DNA, 326 bp, Homo sapiens
aaagcagtaaaaattgaggtgcccttggatatccacaagcctaaattgagtacacccttgaaccagagcccctcagttaatggggtgaccgacatggggtagctgatcccagggggcattcccctctcgagctggccctgcactgggtggcctggggattgtgcttccttgcacagtggtgcacatttctatgtgtggatgagattttcttgtcaacttttcctgccaagacactaaatgcttttcagtgctaatactgacctgatagtagagatttctttccctgagtcggatggtagcaggatttacttggtaacccttggttt

SEQ ID NO: 9345 - DNA, 228 bp, Homo sapiens
ctggaagatggccgtactctttctgactacaacatccagaaggagtcgaccctgcacctggtcctgcgtctgagaggtggtatgcagatcttcgtgaagaccctgaccggcaagaccatcaccctggaagtggagcccagtgacaccatcgaaaatgtgaaggccaagatccaggataaagaaggcatccctcccgaccagcagaggctcatctttgcaggcaagcag

SEQ ID NO: 9346 - DNA, 466 bp, Homo sapiens
ccttctgcgccctccctgagcaccggctcaggcaccggggtcaggctgcaggaacacatggacagggagaagtaagagtagtccactgcaacgtatgtcagcatgaagttgatggtgacgatgggggccagaacgttcacttgacccacaaaaacaaaggccatggtcaccaagctggtcaggcagatggcagccacgggtgttttgtttggccccttcccttgtcccagacaggcaagtgcagggatcactttctcctgggcaatgcactgcaggatgcggggagctccataaagtcctcccatgcaggaagccagggacgagatgtataagcccaaaaggaacaggaagcccatgagggataccttttccgctatcaggaagtcatagcgaagggcctctcgagtgcagatggcgcccaggaggaagacgaagacgatgtacagaaaccacgagatgccaacag

SEQ ID NO: 9347 - DNA, 527 bp, Homo sapiens
  misc_feature (1)...(527): n = g, a, c or t
ctgagctgctgtctgctttggaaaaccgttcctgccgctgccgatggatggaaatgcaatggatttcancttcttatcatcagccagggccaagcagtttttcactgtcttttccagaagttcttcacacttgtctgcatcccaaactggactattacagnggatcacaaacttggcaggcaggccatggcctgcgctgacagcagctccagctacttccaagggcccgttctttttccggagttccaggacagcttccacaaactcctcatagtcgatggtcctgtccccatccttgtcggcctccttcatcatctgctccgcctccacctcgttgaggggctcccctgcgttcattagcacgtacttgagtgtgttccagtcaatgtagcccttgccctctttgtcaaagacacggaatgccgccctcagctcgctctcctggttctgggccttctcatggtaaactcccattagtgccaggaaaccatcgcagttgaagaaccctttgttgnctctgtccacat

SEQ ID NO: 9348 - DNA, 288 bp, Homo sapiens; identical to SEQ ID NO: 2745

SEQ ID NO: 9349 - DNA, 580 bp, Homo sapiens
cctgaggatagacagaatgactcagaaaactccttttgaatgcagccagtctgaggttatgtttctgagcttggacaaaaagccagagagcaagagaaatgaggaagcttgcaacatgcccagttcttcttgtgaagaaagttggttcccaaagtatatagttccatcccaggacttaaggccctataaggtaaatatagatccttcttcagaagctccagggcattcttgcaggagcagtccaaagatggtgacaagtcttttttcttttactttcaaggcagttttaggaagcattccctgtctatcttccaaatatgatctggattttaattttgcaaaaaaaatactgcattttctcacttaaaaagtaggagctaaatgatgagaacacgtggacacatggagaagaacaacacacagtggggcctttcagagggtggagagtgggaagagggagaggatcagaaaaaataactaacaggtactaggcttaatacttgattgatgaaataatctgtacaacaaacccccatgacacaagctgacctgtgtaacaaacctgcatttgtacccctga

SEQ ID NO: 9350 - DNA, 299 bp, Homo sapiens
ctggatttattacttataagtttgctattaacctggtatagctgtattttaatactagggtcatcagatgaagaaagcaaatctaaacaagaaaataatgtcctggttatgtgattatcacatacaggtgggagtacctacaggaagggggaagaagtgaaataattttgaagggacaagcctaaacagtccgagtgggtttccgagtgtgcaaacagtggaaccttcagagattatttttacaaaagaaatgatcagactactagcctgtgtctttgaataaccatccattccccttt

SEQ ID NO: 9351 - DNA, 413 bp, Homo sapiens
tgaaaatcgaatcgggtgtgatcctaggccaagctcatggcccagcagggccagcaggggcagatggcaagtggagacagcaatctcaacttcaggatggtcgcagagatccagaacgtagagggtcagaacctgcaggagcaggtttgccctgagcccattttcaggttcttcagagaagacaaggtggagattgcaagtgcaataacaaggccatttcctttccttatgggcctccgagaccgctccttcatctccgagcagatgtatgaacattttcaagaagcttttagaaacctggtcccagtgacaagagtgatgtattgtgtactcagtgaactggagaagacatttggctggtcacatctggaagcattgttcagcaggattaacctgatggcctatcctgattt

SEQ ID NO: 9352 - DNA, 146 bp, Homo sapiens
aatgacgccgtcatggcacggggaacatttgccaacattcgcttgttaaacagatttttgaacaagcaggcaccacaggctatccatctgccttctggggaaatccttgatgtgtttgatgctgctgagcggtaccagcaggcagg

SEQ ID NO: 9353 - DNA, 391 bp, Homo sapiens
  misc_feature (1)...(391): n = g, a, c or t
ctgttgtagtcccaaactctgggctcaagcagtcctccaacctcagcctcccaaagtgctgggattacaaatataagccactgtgcccagcccagttctgtttttttttttagatggagtcttgctgtctcccagcctagagtgcagtggcacaaccccagcccactgcaaactctgcctcccaggttcaatcaagcgattctcctgcctcagcctcctgagtagctggcattacaggcatacgccaccacacccggttaattttttgtatttttagtanagacggggtttcaccgtgttagccangatggtcttgatctcctgacttcatgatccgtctgccttggcctcccaaagtgctgggattacaagcgtgagccgctgcacctgg

SEQ ID NO: 9354 - DNA, 340 bp, Homo sapiens
ccagggcccctgcagcctgcctgaatttcaactgcatgctgattctcttgccagtctgtcgaaatctgctgtccttcctcaggggttccagtgcgtgctgctcaacaagagttcgaagacaactggacaggaatctcacctttcataaagtggtggcatggatgattgcacttcactctgcgattcacaccattgcacatctatttaatgtggaatggtgtgtgaatgcccgagtcaataattctgatccttattcagtagcactctctgaacttggagacaggcaaaatgaaagttatctcaattttgctcgaaagagaataaagaaccctgaaggagg

SEQ ID NO: 9355 - DNA, 304 bp, Homo sapiens
  misc_feature (1)...(304): n = g, a, c or t
cctcaggaaacttacagncatgacagaaggggaggcaggcatgtcccacatggtggagcangaggaagagctcacctacagcaaattatttaagaccgagcatttgtctctgttctgttccctctctggacgcaccctcctgcctccaccctgacttgccgtctcctgagcactgaagatatttttggcttgtccgatgtgactccacagacagcagaaacgcttgcttgatcagggcagcatcagggcaccacacatgcctgggcttgcacaacgcancgggagcactgccactcagcagcag

SEQ ID NO: 9356 - DNA, 297 bp, Homo sapiens
ctgagagaggctgaagagattctgcaagtaagcttccacgcagaaggtgttggaaagactttgagagtcccccagctttctgaccctggcttttgtggagaggtctgggaagatgggagatagtgagctcaaagaaggagaagataatggcgtatgtcccacattttctcccagggtatggcagcctccctaatacccttataagctaggaagctcctaggatgctgcagctcagtcaccatttagtaatgtctggagagatttgtggttgtcctaagagtgggagggtgctgcagg

SEQ ID NO: 9357 - DNA, 230 bp, Homo sapiens
  misc_feature (1)...(230): n = g, a, c or t
gtacaagctttttttttttttttttttttttttttgggacanagtcttgttctgtctcccagtctggatggagtgcagtggcgccatntcggctcactgcaacctctgcctcctgggctcaanaaattctccctgcctntgcctccanagtagctgggattacagatgcccgccaccacgcccagccaattttttgcatttttagtagcgacggagtttcaccatgttgg

SEQ ID NO: 9358 - DNA, 373 bp, Homo sapiens
ccaacatggtgaaaccctgtctccagtaaaaatacaaaaaatagctgggtgtggtggtgcatgcctataatcccagctactcaggaggctgaggcaggagaattgcttgaactcgggaagcagaggttgcagtgagccaagattgtgccactggactccagcctgggtgacagggcgagactctgtctcaaaaaaaaaaaaagggaaaagaaaatgtagatttccattgtccaaagtgacagcgggaggatgggtcttgagtttctcaggttggagaagcagctccacgaaggtcctgagcttgggtccactgtacatgggacagctccaaaagaggaaggtcccagcactgcatctagtggtgaggcatcag

SEQ ID NO: 9359 - DNA, 222 bp, Homo sapiens
  misc_feature (1)...(222): n = g, a, c or t
ccttcaactgtcaagacaaactttgcaactggatcccggtgggacagtgccctgcagcgaggagtactgtatatgccaatgagagggcccagcttctangaaccgttacaatggcgtcccgagtcattttccctntcccacttgcattcgagagtgagaaaacacacaaggtggccttgattctcactcaccacaatccccntgtacanaggggtctgtttc

SEQ ID NO: 9360 - DNA, 323 bp, Homo sapiens
ccttggcatggaggaggcggcctctcctggcaactcaccaatggggacttatcattcatataaaccatggggtcctgcagaggaagaaacaagagtgaaggactaagaattctggagctgaaagcaccaagaatgcaggggacccttgccccagccacctggggaggtggaagaggacacagatgggtgcagggcaccgacatccttcctggggtgctcaccagggacttctcctcctgcctgagccactggtagtcctccaccatctgcttctgctgtttgtccaggatttgccgcattttgaccttttcagcctcccacag

SEQ ID NO: 9361 - DNA, 290 bp, Homo sapiens; identical to SEQ ID NO: 159
  misc_feature (1)...(290): n = g, a, c or t

SEQ ID NO: 9362 - DNA, 232 bp, Homo sapiens
cctagtatctggcttgtgttttttgggtataacgtggtgactccacagcctctccagctcaggacagcagggctttgaaagcagagaatttgggtatgaatcctagattttccaatgactaactctataatatggaggagttctatctgattatcctcgaatcatcctttgtaaaatggaataatatgcttctcttccttcgatttgttgtaaggagccaatgaaactgtgg

SEQ ID NO: 9363 - DNA, 529 bp, Homo sapiens; identical to SEQ ID NO: 552
  misc_feature (1)...(529): n = g, a, c or t

SEQ ID NO: 9364 - DNA, 293 bp, Homo sapiens
ctgccacagacacccccttcctgtttgaagactgagataatgtctcccctgtaccaagatgaagcccctaagggaacagaggcttcttcggggacagaagctgccactggccttgaaggggaagaaaaggatggcatctcagacagtgatagcagtactagcagtgaggaagaagagagctgggaacccctccgtggtaagaagcgaagccgtgggcctaagtcagatgatgacgggtttgagatagtgcctattgaggacccagcgaaacatcggatactggaccccgaagg

SEQ ID NO: 9365 - DNA, 308 bp, Homo sapiens; identical to SEQ ID NO: 4308

SEQ ID NO: 9366 - DNA, 373 bp, Homo sapiens; identical to SEQ ID NO: 6

SEQ ID NO: 9367 - DNA, 444 bp, Homo sapiens
cctctgcgattttgaaggacaactgctgctaaggagtctatctgtgattggagggttgaaacagtattaggtaagtcttccaaactgtttgtaagatcttgtgagagggagcaatagtacatgagggaagtagaaagcccgaccactccggttccaactgcagtagtcattcctagtcgtactaggatgggtattaactgaacggccctgcattggcacacttgagtttttacagggataggtaggttttgtttcctgggacaatgtcgatttttgggcttagaaaaaccagagtacaggtaccagtccagttgatagggtagcagaggtaggtggaggtaccgcacaggaagaatatgccttggctaggtaagtaaaattggttgtgtatgttaaaaagatgtgtaagcttgtggtctttgtatatccatgctcctagggtgc

SEQ ID NO: 9368 - DNA, 445 bp, Homo sapiens; identical to SEQ ID NO: 4402

SEQ ID NO: 9369 - DNA, 441 bp, Homo sapiens
  misc_feature (1)...(441): n = g, a, c or t
ctgtgtgcggcgacgagagagtgtagaaataaagacacaagacagagataaaagaaaagacagctgggcctgggggaccactaccaccaatgcgcggagaccggtagtggccccgaatgtctggctgcgctcttatttattggatacaaagcaaaaggggcagggtaaagagtgtgagtcatctccaatgataggtaaggtcacgtgggtcatgtgtccactggtcagggggcccttccctgcctggcagccgaggcagagagggagaggagacagagagaaagacagcttacgccattatttctgcatatcagggactattagtactttcactaatttactactgctatctagaaggcagagccaggtgtacaggatggaacatgaaggcggactangancgtgaccactgaagcncagaatcacagggagacggttagg

SEQ ID NO: 9370 - DNA, 493 bp, Homo sapiens
ctggctaattcagtcatgcaaactctgctctcacagttaaaacagttctatgagccaaaacctgatctgctgcctcctctgaaattagaagcttgtattctgacccaaggagataagatctctctacaagaaccactggattatctgctgtgttgtattcagcattgtttggcctggtataagaatacagtcatacccttacagcagggagaggaggaagaggaggaggaagaggcattctacgaagacctagatgatatattggagtccattactaatagaatgattaagagtgagctggaagactttgaactggataaatcagcagatttttctcagagcaccagtattggcataaaaaataatatctgtgcttttcttgtgatgggagtttgtgaggttttaatagaatacaatttctccataagtagtttcagtaagaataggtttgaggacattctgagcttatttatgtgttacaaaaaactctctg

SEQ ID NO: 9371 - DNA, 261 bp, Homo sapiens
ggcaaaagaagatctgacagctcctatataccttatcttactgaattcttaaactttgaaccagttcttccacttactgacttgttaccactgctgactttctgaaaagttttccagtttttgttttttgttttttgttttccagtaggggattagaatgtttagtcctacttagtaagaaaaatattgtatcaaattacctttaggctatgtatataaggtgtatatgaagcataaatgaatttcatgtttagtcttgag

SEQ ID NO: 9372 - DNA, 158 bp, Homo sapiens
ccgaccgcgagccgtccaggtctcagtgctgtgccccccccagagcctagaggatgtttcatgggatcccagccacgccgggcataggagcccctaggaacaagccggagctgtatgaggaagtgaagttgtacaagaacgcccgggagagggagaag

SEQ ID NO: 9373 - DNA, 618 bp, Homo sapiens; identical to SEQ ID NO: 334
  misc_feature (1)...(618): n = g, a, c or t

SEQ ID NO: 9374 - DNA, 274 bp, Homo sapiens; identical to SEQ ID NO: 160
  misc_feature (1)...(274): n = g, a, c or t

SEQ ID NO: 9375 - DNA, 242 bp, Homo sapiens
ccactaccccaacaccatcgctgagaaacacggcttcagggacctgcggcagttcatcgacgagtatgtggaaacggtggacatgctcaagagtcacattaaagaggaactgatgcacggggaggaggctgatgctgtgtacgagtccatggcccacctttccacagacctgcttatgaaatgctcgctcaaccccggctgtgacgaggatctctatgagtccatggctgcctttgtcccag

SEQ ID NO: 9376 - DNA, 591 bp, Homo sapiens; identical to SEQ ID NO: 639

SEQ ID NO: 9377 - DNA, 404 bp, Homo sapiens
ctgtgagcctcagagctcctggctgcctgttgctgagtctattagctgctgagccttgatctttgtgtttctaagatttgtcctagtccatttatggatctaattgtcgctcttaatttctttacatcttcttctggaaccaggtctgttttattaatgagaatggcatctgccaaagcaacttgcctagtagcttcattgataaggccatcaggtttctcttctgttaaatgttttaatccatattttgaatccacaatagttatgataccatcaagataaatatcactccctaattcagcatcaacccaaaacatagaagccactgcaccagggtctgctaatccagtggtctctaacagtatgtaatcaaatttccccttcttttgcatcaaattctcaat

SEQ ID NO: 9378 - DNA, 428 bp, Homo sapiens
  misc_feature (1)...(428): n = g, a, c or t
ctgcagtaacttttcaccccatcattataccagtgctcatctgactgatgaaaaagaggaaagaataatcatttctagatactgaggttgcgaactagttctgtggcagnggactancataagtggatgtctaagaaatttttcagttcactagactaaaatgttttacaacaaaaagcctccagttagcctcctttctagagtatatgttcagcaatgttgatctcataaaaggaaaaacaaaagatttaagtattctatataccaagtttttgttttgtttttactgnatttattttattgaggntctttatattcctgcctcttcatagtcaaggctcttagtacaggaatattgacttaggaattgngaaaactccttaagtttcttaagttaaggatgtttggcttttttctttaattttttt

SEQ ID NO: 9379 - DNA, 293 bp, Homo sapiens
  misc_feature (1)...(293): n = g, a, c or t
ccacacctggngttctggaaaagggagtccagggccantattnangccctgctgtactgcaccctgnaaactgcaccaaaccccanctccgcccccatccacggntcccanaatggtttctggagtccctgcancagacctgtgaggagagggcanggcagggcctgcctnctgcgtccccgngatgacctgggggatgcactgggcagggacagcttcctccatccacacagccctgtgggcaccaacaaggccnctgtgacttcacgcgacagcagtgtnccccagctcag

SEQ ID NO: 9380 - DNA, 378 bp, Homo sapiens
aaagtttgcccttgtgctaaagtgccagtgtatgtatgttatacttgatttggttgtaaactatatttcaaagtaaaccctagtgtaataagttttataactaaaaaggtttaagctgctaaaactatttttaagagatgtgaaatgcagtatgggactatctttttttcctcctctaagcccaaagattaactagagtccctccaaccttatagattgttggctttcacaatcttataacctaggatacaggtagtttcgagtatggtgccagtgatgttttgtttttgtttggtcaaggggtaggtgcaacccaatggaccacttatgcaaaagatgtaaactcttgcataatacattgataacatgttttgccaa

SEQ ID NO: 9381 - DNA, 569 bp, Homo sapiens
ctcagataagctgacatttgagcagagacctgtgctaagtgagggagtgtgccatgaggatatctgggaagagcaccttgggaaagggtcagcaagtgcaaaggccctggggtgggagtgtgcctggcatgcttgagaaagagcagagagaccagggtggctggagtggagtgggagaggggtgaacacataggaaatgaggttcagagggtagatgggggccagatcaggaggccaggtgttaactgtgagcaaagtgggagctgcaggaggagtgagagcagaggacagatgggatctgatttgggactgggaaaggcagagaggcttgcatggcagtggggcccatgcctgccttctggtcagagtagatttcggggagggcctgagggactcctcaggtcctgtgccagcctgggcccccaagaaggcagagctaggggtgaaggctggctccccttccgggaggcccgcaggcagcggtcgcttgtccaggcaggaggatgttctcactgactcggaggaaacagcgtgtcccacatcaaaagggggccgggtggctcccacgc

SEQ ID NO: 9382 - DNA, 188 bp, Homo sapiens
ctgccccgaggccaaggctgcgctgaacatgcccagggcctgctggaactggggcgaggtcagggtattctggatctcatccgcggtctgcggcagcgactccccagatggcaagcagggaagcaggcgctcctggacatccgcgttggcgaggatgggagccattatctccggcgtcagcacactgg

SEQ ID NO: 9383 - DNA, 267 bp, Homo sapiens; identical to SEQ ID NO: 4373

SEQ ID NO: 9384 - DNA, 349 bp, Homo sapiens
aaatcgaaagatggtgtggcttcattaaaaacagtagtgaccaagtcactagcttgatctattgttaaaacattgttgtttactcgattaccaacttcaatatgtacatcagctaatgatgatataagttgtttacattcattctgcattcgtgtgaatggaacggcaatttcgtcataatataaatgttctgaaaggatatcaagtaaacgcggctgcacagctaaggtaacagctttacactccttttgtaaagcagcccattcacagattaccaaagctacactaatcctctgtaaagcagacttggagttcaaatggaagagtagtaactggcccagggattcag

SEQ ID NO: 9385 - DNA, 181 bp, Homo sapiens
gtgtccatgtacctcttccgggtaacagtgaccagtgactcccccaagctctggatcctggtattgggagctgtatttggtttctcctcgtatggccccattgccctgtttggagtcatagccaacgagagtgcccctcccaacttgtgtggcacctcccacgccattgtgggactcatgg

SEQ ID NO: 9386 - DNA, 301 bp, Homo sapiens
ccagacttggtgctctccatagagcagtctgggattatcttggagagctgcacgatccagttgttgatcttgtctcggcggcgacgctccacttcattatgctgagccctgcgtttctcatcccgagtcgtccggggagcttctgacttcggggaataagggtgagtcctaggggcaattgagcgctggcttcctccctgcagtacttcttgtggtgacatcatcacaaagaattgaccagtgccaggaggggtcgcctgccccagcagtgcctctgagccctgggtagtaacaacagcag

SEQ ID NO: 9387 - DNA, 531 bp, Homo sapiens
ctgctccatgtccttcacctctgccagggcctcatcccggagaaggcccatctgctcgtggttgtagaaggggcaggctgcctgcttttcctgcctcctcctctttggcttctcctcctcagctcctttcttcttctctgagggtggcacaggcacaaagagagaaaacagagaggacagcaactgtccacgggcccgagagggggttgtgtaatgttgagacccacttccacagggtggggtctataagaccctcccaagtactgcctactgtgtctcatcggaacactgtaaggttttacttttgttctccagaaagagcccgtaaaatcatctccaagccaacgattcggaccagacgctcacccagagagtaggaacactttttcccaaggagaggggactcaggaaggaactggggtctcctctgccattctttctatgaaagacacttaatggtcttcagtcactgccacccctgcctcactctctccagaccacctgcggctacaccatggtcctggtggctac

SEQ ID NO: 9388 - DNA, 289 bp, Homo sapiens
  misc_feature (1)...(289): n = g, a, c or t
agtgctgaataaatctcttgctgaacaaagacagcatgaggaagcgaataaaaccnaagatcaagggaagaaagggccnaacaaaagctngagaaggaacaaacagggtcaaagactctaaatggaggatctgatgctcaagatggnaatcagccncaacataacggggagagcaatgaagacagcnaagacaaccntgaagccnncacgaanaaaaagccntccnntgaaganagagagactgaaatatctctgaaggattctacactagataactaggntgacatac

SEQ ID NO: 9389 - DNA, 375 bp, Homo sapiens; identical to SEQ ID NO: 161

SEQ ID NO: 9390 - DNA, 389 bp, Homo sapiens
aaatgtataaataatgtgtacctgtgcacataaataattaaatggggagagagaggaaagaaaaagatagaggagaaaactaaagtgctgtccttttgaagtcaacattacaagtacatgagattcctgtgttaatttaaggaagactttcctgttggtttgttgaatgctctgtgtttcctctgtaatgctttcttagctctttctattgtttcctcaggcattatttcattttcccagttactgtatatttgtacctgcttctggtatgttaagtcctttatcttctggcatgaaccacttgcccattccatcagtgtgcactgcttcttccagtgtcctacgtcaagtgttcactcagagacgcttctattctcatttccagttgg

SEQ ID NO: 9391 - DNA, 269 bp, Homo sapiens
aaacctcacttaatggatgtagtatatacctgggcaactggagctacatttgcccatatctgcaaaatgacagatgtctttgaaggcagcataattcgttgtatgaggcgcctggaagaattgcttcgacaaatgtgtcaagcagcaaaagccattggaaacactgagctggaaaataaatttgcaggaggaatcaccaaaatcaagagagatattgtgtttgctgccagcctctacttgtagagtcagctaaaggaatgtgagatttt

SEQ ID NO: 9392 - DNA, 571 bp, Homo sapiens
cggaatatgacttggacaatctttaccagaagccatccgtaagcccctcagtcacactttccatgtagctgaccagtgactacaggatgtggctgacagtgctcactgaaaggagagttggtgcgggactggtggttctgagcacatagacgcctattagtccttctggtcagtgaacgaaaattctagacctacagttactggctacttgcatttgtcagtttagagaaaaggtaaaatgaggcgttttcaattgtagaatagactaacatttaccacagaagtgcttcagcattctaaatggattagatcactcattaagctatttttatatgccaatttactaatgccttacatcaatccactaataggttgttgggcccgcagtagagtccctatgcagtcccaattctgttttctgtaaccatgtgactggtgatgcagagtgataaccatgtctgcctatcttgtactagactcttcatgctgatcggatcttgcattgaaataaccatgtggaagaacaatgaatcgattaatgatgacatgtacaaccatatttacctcggcc

SEQ ID NO: 9393 - DNA, 265 bp, Homo sapiens
ccagggcctttgcaaacaagccaggccaaaaaggctcaacatttacaccggctgctttaatgagggcattgatcttatcctccgtgactgtcacctcatcgtcgtgcagaatgagggccgagtagatgcaggcgagctcggagacagaggccatggcgcgggcgagtgtagggctggcgctgccggacgcggtgctagtcgccggatgaagtgagggcctcaccccaacgcagccttagcttcctcggaaggaccgagcaccttg

SEQ ID NO: 9394 - DNA, 466 bp, Homo sapiens
aaatgagggcaacaggagatcagagatgccaagagatgttggaaaacagaactggctgaagaaatgacaactgaataaagaggggtgaagggagctgtgaaccacagcaatgccaagagggcatccagccaggcagagtggtctactaggcagagcctcagagaggggaggagttcaccagacccacgtgccatatgggattcatgccagccttgagtctacaccagtgaaaaaaatcagagagttcatgactgaagcaatatgccccagaaataatatctttgtattctgacacttcagtgggttcccattcaatcaccctacagggaagactgccagtagacctgccccccaccccgttcaatatgaatagatctaggatcagaaattggagaaaggtgaaagtggggaaacagaccaagatgaccaaatacaaaaggagtccagaacaaacaagtaatttttt

SEQ ID NO: 9395 - DNA, 392 bp, Homo sapiens
acgaggtcctcctcgctctggccgctcttgctgctcctgtctgaagaaatcagactgatttcctcttaagactcctagggatgtggtgaagagctgggactcaagtgcagtccacggtgtgaaacatgagggaggtgaggtgtccgtccacttcccccataaaggtgtgcatttcagttaggctgccccgctacagagcaggcttcatctgctctgccatccagccccatctggatgtgaggtggggtggagacatcatggggtgattgcagaaagggggagtggcggcccacgcagcttctgctgaggagctgaccgctctgagctgttctgtttcgtattgctgctctgtgtctgcatgtattgtgaccgtgcggctccacctcttccag

SEQ ID NO: 9396 - DNA, 459 bp, Homo sapiens
  misc_feature (1)...(459): n = g, a, c or t
taattgaaatcctnaaaggaatgcaagaattgggagtacatgnntgatcaggaaacatatacagattatgtgattccatgctttgatagtgtaaactcagcacgagccattttgcaggaaaatggatgtctgtctgatagtgatatgttttctcaagctggattganaagtgaagcagcaaatgggaacttagactttgtattatcatttttgaaatcaaatacattgcccatctcgctgcagtctataagaagtagcctactgctaggcttcaggaggtctatgaatataaatctttggagcgagataacagaattgttgtacaaggatggacgttattgccaggagcctcgaggaccgacggaagctgttggctattttctttataacttgattgacagcatgagtgactcagaggtacaggccaaggaggagcatttgagacaatacttccatcag

SEQ ID NO: 9397 - DNA, 216 bp, Homo sapiens
  misc_feature (1)...(216): n = g, a, c or t
acatcctaatatatggatcttgatttttaagtttcagtatctgaacttnntaaatnagtaacttttagctgggaaagtatagcatgaaaccagaggttctcanaatgactgtaagatagcttacatttcctntttttgcgcggtgctagtcgccggatgaagtgagggcctcaccccaacgcagccttagcttcctcggaaggaccgagcaccttg

SEQ ID NO: 9398 - DNA, 305 bp, Homo sapiens
aaaacaaggcttggcaccctggcttatgcctgtaatcccagcactttgtgaggccaaggtgggcggatcacctgagctcagaagtttgagtccagcctggctaacatggtgaaaccccatctctaaaagagtacacggtcctagagcagtggtgtgcgcctgtagtcctagctacctgggaggctgaaccaggagaattgcttgagcctgggaggcagaggttgcagtgagccaagatcgcaccattacactccagcctgggtgacagagagaggccctgtgcccctcaaaaaaatgtttttttt

SEQ ID NO: 9399 - DNA, 327 bp, Homo sapiens
cctggaagcccacggggtgcagcatcctcaagcccaggggcgggagcgcctccggcctgccctccagggaagctgcatgtggacctccacggtattcagcctccagtttagtcagccttgagtctgggctgctcccgcacctggtgttttatgcgtgtgatatatgtgtatccatcctgcttccctgccttcaagggaagacttaactctccgagagaaaacctgcctggagctgcgcacattctcacagcttgagaacgcttgacgcaggaagtcaccagagtactcaagtcaaccgcaaactagtggttacaaaatgggagcttt

SEQ ID NO: 9400 - DNA, 457 bp, Homo sapiens
ctggctttcagagcctttccctgccttctggggccctgtgatccctcatgcctacttctttctctcttggtcagccttgtgcgcatgccctctcactcttcatctcttgggcctgtctctgtttctccttggatgttcttctattattcccctctctccatcctccataaataaataatttaatttttttgccttcataaatagtcccctccctgcctctagtcatcccccaagctcctccatgtgcctgctcttcctctgtgtgtggatctaggccccacctagctggtgggacagaccaacagctttgggctgggaattcctaggcaggcttgaaatcctcagccagacagacatcagggatggttcagggaggtgtggtcccctgggatgcctagaattccttctttgaaagctccggtgacttgatcagggaagacttgagctgttggaatgg

SEQ ID NO: 9401 - DNA, 288 bp, Homo sapiens; identical to SEQ ID NO: 162
  misc_feature (1)...(288): n = g, a, c or t

SEQ ID NO: 9402 - DNA, 153 bp, Homo sapiens
ccatggatgccagccgcttggcatccaggtcaaaggcaaagatccttggttcttcagaagagcagccaagtgactggtcttattgcctggggcggcacaggcatcgatgacatgggagcctggcgggggtccagcagcatggctgggagacag

SEQ ID NO: 9403 - DNA, 297 bp, Homo sapiens; identical to SEQ ID NO: 163

SEQ ID NO: 9404 - DNA, 382 bp, Homo sapiens
ggcttcttgcaggccaagcccgagaaggcagcagtggcccagaagccccgaagccacttcacgacacctgcccctatgtccagtgcctggaagacggtggcctgcggggggaccagggaccagcttttcatgcaggagaaagcccggcagctcctgggccgcctgaagcccagccacacatctcggaccctcatcttgtcctgaggtgttgagggtgtcacgagcccattctcatgtttacaggggttgtgggggcagagggggtctgtgaatctgagagtcattcaggtgacctcctgcagggagccttctgccaccagcccctccccagactctcaggtggaggcaacagggccatgtgctgccctgttgccgagcccag

SEQ ID NO: 9405 - DNA, 297 bp, Homo sapiens
aaattccaaagcactcacaaaattgagcaaacaaagccactatttgcatatttgggaaaggaaacatattgctaatggaagccacaggactggtacacaggccccactccctccagctccattcccaagcacaaaattcaacagacccagatcctaagtcaaccaagtgactgctatgacaaaggcttgggttattgacatttacttacatacgtgtacaagacctagagtttgaaaataaatggagaattctaccccaaagcctccacctcagtgaagacctgcgggttattgcag

SEQ ID NO: 9406 - DNA, 342 bp, Homo sapiens; identical to SEQ ID NO: 306

SEQ ID NO: 9407 - DNA, 230 bp, Homo sapiens
ctggaggatcccggggcagggacacctagcccggtgcgtctgcatgccctggcagggttccagcagcgagccctgtgccacgcgctcactttcccttccctgcagcggctcgtctactccatgtgctccctctgccaggaggagaatgaagacatggtaccagatgcgctgcagcagaacccgggcgccttcaggctagctcccgccctgcctgcccggccccaccgagg

SEQ ID NO: 9408 - DNA, 512 bp, Homo sapiens
cctcctgctgtggactgctcttcttaggacaacactggctccacacaagtcagcgaggatggggtcatctttagtcaacatggtttcaggtgtaagttctcaggaagtgtttgttgaatgcatgagtggacaaaggggaggacaatgaaatgagacggaattccgtgtgtttcctgggcagttggtgcaggtgttcctctctcaggaatcacagcttgttaaaggtcatctgcctgctatggacaggggctcccatgactcgtctggaactgtatcacctcccaaagcctggtgatttcaggctcattcttggggtagacaccacctcctgagtcccttcctttggttaccctgctgtccaagggccccacgttggggtgcctactcacccaggtccatgtttcgagtccgggggttacactgcttgtaacccttgcagctcctcagctccatgagctgtacgtgtagctggttgaggacatccctgtccagtgtgttcactgcattcatca

SEQ ID NO: 9409 - DNA, 308 bp, Homo sapiens; identical to SEQ ID NO: 4688

SEQ ID NO: 9410 - DNA, 300 bp, Homo sapiens
aaaaagcaagttactgtccagccaggtagtcggacacggaccaaagctggcagaggaagaaggagaaaattctgaatttctagggtccaaaagttgacaaaaccattagtaggaggggtgggccatgttcattaagccatagtggtccctagttcattgttgagcaagttttagccctgcagttttcaccaccagcacctacccagcattctggtttttatgttttttatgatctatgcagacaactgtgtattctgttttataacagtttgtttgaatttacttacagttaaaaaattt

SEQ ID NO: 9411 - DNA, 75 bp, Homo sapiens
ccaggatctcggcgcatagaccactctgccccagcggtcgtcacagaaaggtctctctgttccccacactcagca

SEQ ID NO: 9412 - DNA, 335 bp, Homo sapiens
cctgatggctggaccctgctcactgctgttgtgggaccctgaaccctcccttcaccttgcttgcctcctgcctcggaagctccttgggtgtgggtgaagcccgaggctgctcctgtggaagtggctctgggcaccagcctgtggggctaaagacttgacagctagctctggagcagccggcttcctggaaaacctccaggtttcgcataccagggatggcccctggcttggcctgcgaaggtgaacctgcccagatttatcagtagaggctggactccctctgtgtcctgcccatggttgcagcagccatgggcctatgagcggtctaactgtgg

SEQ ID NO: 9413 - DNA, 551 bp, Homo sapiens
ccagccagtgacagaaaaaagagtgaatgtgcctttaagaagaagagcaatgagacacagtgtttcaacttcatccgtgtcctggtttcttacaatgtcacccatctctacacctgcggcaccttcgccttcagccctgcttgtaccttcattgaacttcaagattcctacctgttgcccatctcggaggacaaggtcatggagggaaaaggccaaagcccctttgaccccgctcacaagcatacggctgtcttggtggatgggatgctctattctggtactatgaacaacttcctgggcagtgagcccatcctgatgcgcacactgggatcccagcctgtcctcaagaccgacaacttcctccgctggctgcatcatgacgcctcctttgtggcagccatcccttcgacccaggtcgtctacttcttcttcgaggagacagccagcgagtttgacttctttgagaggctccacacatcgcgggtggctagagtctgcaagaatgacgtgggcggcgaaaagctgctgcagaagaagtggaccaccttcct

SEQ ID NO: 9414 - DNA, 134 bp, Homo sapiens
  misc_feature (1)...(134): n = g, a, c or t
ccttgacaattaggcagggagaagacctggatgtccatcccatctgataccctgacttcccaagagaacaacccattcttctcanatttctcccaagtccctcattgctgggcctggangctcgctttggctcc

SEQ ID NO: 9415 - DNA, 210 bp, Homo sapiens
  misc_feature (1)...(210): n = g, a, c or t
cctgggatgcagggagaaaggctgaccacaagttgagacaagatacagaaacaaacaaaaacaacagaaagtccgatcgatggtgtaagtgttgtgttcactgcttagggtgcaggtgagcttgatcgaggctcccagcaaggcagatgtagacgggggctgagtcagcncaggcagagcacagagacctgtggagaaaatgaagggcng

SEQ ID NO: 9416 - DNA, 206 bp, Homo sapiens
  misc_feature (1)...(206): n = g, a, c or t
aaacttttgagttgtagtcagaaactgttgttggactgcatagttttcaaaagtttttggtacatttctgactttagaaatctggggtaggaatccctttccatatgcatatagactattttctgagcttcttcaaaacatgtttcagtgggttcctgaatgttcctgatgatngtctctcttgtcgaactgncaatgttaatctc

SEQ ID NO: 9417 - DNA, 188 bp, Homo sapiens
aaattcaccaacaactgggttcactgccaacaactacaaatgttcaattctgtattagtgtacatgtcattacagttggtttagatggttaatataggaataaataaaataactacagttcaaacaaaggaaattaaaatgagattaaagagccccgatcaaaaaaaaaaaatacttacaactttcag

SEQ ID NO: 9418 - DNA, 618 bp, Homo sapiens
  misc_feature (1)...(618): n = g, a, c or t
aaactgtaatagttctttatattcaggtaaattcctatacatgataggaatactttcgtcatctgatgcatcttcaacagcagtgttcatgtggctatgaaaacaagatcggtcatcatcttcatccatatacactggcggttcatgtgaagtcatgaaagtggaaggcttaaagagatgcttattaagagggtgctgtcgtctgcttgttgaagactttttggagtatatatataagtttggtgttctgcctggtactggaatgccagctttagttagctttatgaaatacttctgtactcggctggcaacctgttttgctgtcctgttgcccaattcatctgctatcttctgccagcgtcgagattctacttcttcaggagggtatttgatgagtagctgttccagctttttctgttcttcaacagtccacaactggttaaatgtttcaggtttggtatcatcacacaagcgtcctcttatcatctgaggacgactgcttgagccttctggaccatcactcaaaggcaacatagaatatgaaagggactctccatccttcttaggatctaaaggactttttggtctancaggtaaacctactttatcaaaaactgg

SEQ ID NO: 9419 - DNA, 259 bp, Homo sapiens
ctgtgtggtcctgagctgtcacctcttccctttgaagctcaggttcctcatcggtaaaatgaggcagaaatactcactgctgagatgtgtgaggatcgcacaaactcagtgtctcaacatgttgtacgtgtgttttggccctctgagcccttgagggctgccccaggtggaaccctcttcacttttcttggagaactgaccatgggttgcagcaaagcctaaaatggttcctgtttcagccctgcctgggaagattcag

SEQ ID NO: 9420 - DNA, 395 bp, Homo sapiens; identical to SEQ ID NO: 164

SEQ ID NO: 9421 - DNA, 464 bp, Homo sapiens
  misc_feature (1)...(464): n = g, a, c or t
aaagatactggattntncnaagatttctgatttacactgatatttttttttgccattcttaattgcatcacacaatagatgtaaatgaagatgtagtcacctcagataaaattggtatcgngtatgataatattgtatcatttatatttgccttatgttaactttaagaaattgatttttttgtattaatcattttcccattgcaacagagctatattttttctattttaagaattatattttaggattatttttggcaaatacagtgagcacttatgtaaccagatgataatgaactcaaatgtcatgatggcttgcataaatggtgactctagtagatttgactcaagcacttctagaatcatgcactgaattcaaaagaaaaatcttgctgctttttgtccagggcttgttctattcaacttctaatttgaaagctgtacaaagtaatagaagttccattt

SEQ ID NO: 9422 - DNA, 347 bp, Homo sapiens
ctgggttggcacaggctttctccacttctgggcctacacagtccttcaagaacagaacatccttgcccagcagagatttgagttctacagcaactggctctaaggagtacttgtcaggcatgggcacaccatcaggccggcctaggtggctcataaggactaccgacttggctccattgtccaagcagaatttgatgcttgggacagcagccttaatcctctggttgtttgttatctggttgttcttcataggaacattgaagtcgactctcataacgacccgcttccctttaacgtccagcttgtccagcgtcagcttgttagaaagcgacattttggaaatacag

SEQ ID NO: 9423 - DNA, 310 bp, Homo sapiens
aaaggatggcctggcccccagtaaacgccgattcctgctcgcggccttctacgcccattactggagcagcagccatcagtgtagacgacgacgaagtctcccatgtaggaaaacgtgtctctgctaactggaggcgccggctccacgctcggcttcatgtgctttgcatacggctctgcgctttcatgtccatctccatccagtggctcacggagtcgcttgctggctttcgcctccgattcttgtccatgttgattttcatgcccttctgaaacttccgggcttgcagatttcctgacaaaggcccagg

SEQ ID NO: 9424 - DNA, 332 bp, Homo sapiens
ctgcgtggagtgacgggaggagggaatcactgtgtgtgcgagagtgcttcagactcaatttccaaaataattttcacccctctaagcatgtaaatatacaaagatggatccttcatagaaattaaaaaatcaatttgagctcatttcgaatacagaacaagtatggcacagatggaagtcctgccacgtttcctttaatgatgctgactcttgtatcacacaggccagcatgaagtttcttactcagactttacaggcattttccgtaattcaatcagtcctgctcccagcacaacacaggaggtgattcaagaataatcgcgagaatcagg

SEQ ID NO: 9425 - DNA, 332 bp, Homo sapiens
  misc_feature (1)...(332): n = g, a, c or t
aaagaactanttnntaaattatgacacaaaattttattaacaaggaaatatccattaattgactactacagtaaaaactttataatgcttgtatcatgaagaaagaccttccttttccttatatattaattgaactacataggcttgctgtacattttgttattcatgttataagaattctagattccattgcttttgaaatatgtttctttttaggaactaaaagtcaacttatagtttgatttctgttttatttgtactgtgtttctgattttgtgggtttctaaataaaaagatcaaacccaccactttcaatatactgttttctattt

SEQ ID NO: 9426 - DNA, 292 bp, Homo sapiens; identical to SEQ ID NO: 29

SEQ ID NO: 9427 - DNA, 299 bp, Homo sapiens
ctgtcagcaggaagaagtcagtctccactgcctccacagtctccactgccacgctgtcagccgtgggaacaataaaaagcagccccagaatgtgaagtcagtctccactgcctccacagtctccgctgccacgctgtcagccgtgggaacaataaaaagcagccccagaatgtttgctgctgtcgtgcatggacgacaccattgcacataaaagcactagtgctccattattgcagttgggcctcctgaaaacccctagagctggagagggcaagggagaggcttcctctgatcttcag

SEQ ID NO: 9428 - DNA, 377 bp, Homo sapiens
cgtccagcgagccgccgctggatgctaagtccgatgtcaccaaccagcttgtagattttcagtggaaactgggtatggctgtgagctcagacacttgcagatctcttaagtatccttacgttgcagtgatgctaaaagtggcagatcattcaggccaagtaaagaccaagtgctttgaaatgacgattccacagtttcagaatttctacagacagttcaaggaaattgctgcagttattgaaacggtgtgaagacggattctttggttgataaattgctatcattctaaagtcatggacttcactttcggcaacaaaactaaataaggatggaacatttattgaatgaaaaatgcacttttgtttttccattttttt

SEQ ID NO: 9429 - DNA, 487 bp, Homo sapiens; identical to SEQ ID NO: 6908

SEQ ID NO: 9430 - DNA, 409 bp, Homo sapiens
ctgcaccatccccgttgccacgggccgggaaaaaaccaacgacaccactgaagacaactccagttgcctctcaacagaatgcttcaagtgtttgtgaagaaaaacctatacctgctgaacgccaccgagggtcaagtcacagacaagaagctgtgcagtcaccagtgtttcctcctgcccagaaacaaatccaccaaaaacccatacctctgccaagatttacagaagggggaaacccaactgtggatgggcccctacccagcttttcatctaattccactatttcagaacaggaagctggcgttctctgcaagccatggtatgctggagcctgtgatcgaaagtctgctgaagaggcattgcacagatcaaacaaggatggatcatttcttattcggaaaagctctgg

SEQ ID NO: 9431 - DNA, 619 bp, Homo sapiens
  misc_feature (1)...(619): n = g, a, c or t
ctgggacttgctggtaccagggtcgccacacagcaagatgttgatctcagcccgaaatttgccccttccagtgtgactaaaatccttccttgtcccgccaaagagctgaagcaaaattcccttctttatatcttcatgttcataaatgcttggagccaaggctgaagcaagcctctcataaatgtctggtttcctggaaagttccttaagcaattccacacgtttctctgaaaaaagtttctgttctgcttcttcatcaaggccatgcagacgttttgcatccgttttccgataatgaatgacatcaatgtgggttttgtggacagacttcacattactcactcttggattgactcgaataggcacagctcgatagatgcctgtaacattcactctgtccccaggctggaccttgtcaacgagatcattgtgagcaaacaggataactgtgtgtggtgtctgccctgcaggcatgtcttccggagactcctgaagcttgatcatctgcttgtcagagaaganggagcggttgtggatgagtgccatgctgtgggtggtgtggcagcgcccgcacacactgggctctgcaatgcggccgcggtccatctccacccgggtc

SEQ ID NO: 9432 - DNA, 333 bp, Homo sapiens
  misc_feature (1)...(333): n = g, a, c or t
ccaccctgactgccttctgccgctgagggcgccgctgggcctggcgcaacctgtgcactacccccacgtagcaccagcccatcaccagcatgggcagcaggaatcccgccacatggtagaggaatcgggaggtgaaccaggcatgcgtttctgcttggttctcttgggagaaggtgcaacgtggcagggagttgttgtgatggccttggctgactttggcgaanagaatctctggcaaggcaaggaggaagcccaccagccagatggtcccacaggtgatgtggatgganaggaggcggcggtggcggtaggcatggacggcgtggacaatgg

SEQ ID NO: 9433 - DNA, 476 bp, Homo sapiens
  misc_feature (1)...(476): n = g, a, c or t
ccactaggaagcttanatccacacatacgcccacttcctggctcttggtttttccttgtccttgtttggtggccctttcaccttttcttttatgtttttgctgcttgcgatgttgaatacacctcntgagttttccctcaaatgcantttggaacaggatggctctggatgggctgatggatgatttctcctcccctttgtgttctggcctttctaggagggtgaggacaaaatcttcttaatcaacaagcttnactccatctacnagaggaanganagggaggagaggagcagggttgggacaaccgaggaggctgcggcaccccctgccctgctcacagatgaacaggatgcctagggggacggcgatgggcctnacgggcccgcccagcaccctgagaccacactgttgcctcccagtgaccctgctgggacaccagnacaaggaagacagtttcgcctctngaaagccgcag

SEQ ID NO: 9434 - DNA, 348 bp, Homo sapiens; identical to SEQ ID NO: 5566

SEQ ID NO: 9435 - DNA, 469 bp, Homo sapiens
ctggggagggggcctggtccatgtacgtggcgctgccgcccccggcatctgcagatgcgttcacaaactcagggaccacttgcttgatctgtggcttcacgtatccatcaacagctttagcagtagcagactcgcagggaactggtgtgtagtatttggagtatacttcatcttttggccgatcaggaaacacgtagataaggtaattcaagtctcccaagcggtcggctagggaccgaatggagaagtctctggtggtaaaaggcatcagattccaaaacattctttcctgagaatcaaacttccaagcaatggtgatgccgccaatttctgagtcactgaatctcaggaggaaggtcccatctggcttgttaatgagtaggtcatgggcctgttgcttgtttacaaaccccaaaatggccccatcattccaatgaggcttgagatgtttttttaacacttccatcac

SEQ ID NO: 9436 - DNA, 577 bp, Homo sapiens
aaacaaggttctcgaggcaaataaggaatcttgagaatccgtgggcatgcaatgtaacaagtagcactccagatggcgccaaagaataaataggcaggtctctatgataaaagaacaaagggaaagcagtttagctcgattgttgatcaccttcaccaagcgccgtcttgctagaacatatttctgagcagtggagattttatcaacaccagcaggcatcacagactgacacaactcttttatctcatctgggggaagctgctctacattttgtagcttgctgacactctgtcgatgactgtcataatagctgaagaaatcattagcactctgtttcagcaggtagatgataatgcctaaaccaggcaggcgccagtatggaaccactggagcttgggtatcttgccgcggtccatctctattaactgtttctgaaaggctaggagtgaagagacacacagcatgctggaaggtaggggaactctgtaacatgagtgactggcaatattccattacattggcacaaatctgctgcatagccagttcaatctcatctttcttgcttactttatcacct

SEQ ID NO: 9437 - DNA, 185 bp, Homo sapiens
aaatgttccaagtgctaaatttgcaagaaaacaggcactaatttcattgtcatcatctgggaagagttagtgtccaagggaagctcagcgggaagggagggaagtgaggtggggcagggtctggcgctcaggggtctgtggcattgatgatgcttttatccgggggggcccatcctcggtaccag

SEQ ID NO: 9438 - DNA, 271 bp, Homo sapiens
  misc_feature (1)...(271): n = g, a, c or t
agggctgtgtagacggccaggttggctggggacccggagtagggctggacattgactccccactgtgcaggatccaggtcaaaggcttccaaggcccggcgctggcacagcagctcaatttcatccaccacctctgctcccccatagtatctcttgccaggataaccctccgagtacttgttgntcanacaggaccccagggcctncancgcanctcggntgcanaanttctctgaggcaatgagctccaggccacgacactggctgtcct

SEQ ID NO: 9439 - DNA, 150 bp, Homo sapiens
ccattcctgcagtgcctgtccttctcctttggcttatgctatcctcagcagcacatgcattatttgtaagcctcccttacccatttgatactacccaatcaagactctagtataaatgttctgtcccttcaagaaaccttccccagttgg

SEQ ID NO: 9440 - DNA, 210 bp, Homo sapiens
  misc_feature (1)...(210): n = g, a, c or t
gatccaacctctttgcatcttacaaagttaaacagctnanagaagtaaaataagaaggcaatgcttgtggaatgnncantgcatattggcggcgcacgcctcattacgatncgcctgcttgcttntnctgttcaatcnctgtgaccagaaaaaaaaaaaaaaangatggagggagatgattaaaggattcngtacagactaaagggcttt

SEQ ID NO: 9441 - DNA, 371 bp, Homo sapiens
ccaacatggtgaaaccctgtctccagtaaaaatacaaaaaatagctgggtgtggtggtgcatgcctataatcccagctactcaggaggctgaggcaggagaattgcttgaactcgggaagcagaggttgcagtgagccaagattgtgccactggactccagcctgggtgacagggcgagactctgtctcaaaaaaaaaaagggaaaagaaaatgtagatttccattgtccaaagtgacagcgggaggatgggtcttgagtttctcaggttggagaagcagctccacgaaggtcctgagcttgggtccactgtacatgggacagctccaaaagaggaaggtcccagcactgcatctagtagtgaggcatcag

SEQ ID NO: 9442 - DNA, 230 bp, Homo sapiens
ctgaaagtaaacagaatggattgccagttacatgtatgcctgcccagttccctttttatttgcagaagctgtgagttttgttcacaattaggttcctaggagcaaaaaacctcaaggattgatttattgttttcaactccaaggcacactgttaataaacgagcagggtgttttctctcttcctttctaatatatggagtttcgaagaataaaatatgagagcaatattt

SEQ ID NO: 9443 - DNA, 491 bp, Homo sapiens
  misc_feature (1)...(491): n = g, a, c or t
ctgagtcggaggacgagatgatccatcctgagggagtggcttccctgctgcctcctgactttcagagcagcctggagagaccagagctggagctcagcagacattcgcccagaaaaagctcctcaatttctgaagagaaaggtgactctgatgatgagaaaccaaggaaaggagaaagacgatcatctagggtcagacaggcaagagcagctaaactgtctgagggcagccaacctgctgaggaggaagaggatcaagaaacaccttccagaaacctaagggtcagagcagatcgaaatttgaaaacagaggaggaagaagaggaggaggaggaggaggaagaagatgatgaagaagaggaaggtgatgatgagggacaaaaatctagggaggcnccaatcctgaaagagtgtaaggaagaaggggaagagatacctanagtaaaaccagaggagatggtggangagagacccaaaacaagatcccaggaa

SEQ ID NO: 9444 - DNA, 530 bp, Homo sapiens
  misc_feature (1)...(530): n = g, a, c or t
aaaagatagagccacatggacagaaagatcaatattgccctttatagtggctgctgcggttgtagctccgagactatattggagggggtgaggaaggacaagggggccagcaggtgggggacagcggcagacccctcccccaccccgatgctttggtccaaacaccacctctgagggctcccttgcttgggcttctcccaagattcccatccaccctcagaggacacagctactgcctcaactgggaggattcggaaagcttcagaaggtcagaaggcattggtagagggttccgggggaggctgggactacctccccccggagtgtttgaaaagccaggctggttcaggttagatactgaggtggggatgccagagctccatgctgaggaacagggtagagggtgtgggcttctagcacccangggtctgcccccggcagtggggccgccagtagaaacgcantcgcttctggtaggtgtccangttgcgcttcaggcagaaggncacctncttgtcacaggcacacag

SEQ ID NO: 9445 - DNA, 193 bp, Homo sapiens; identical to SEQ ID NO: 166
  misc_feature (1)...(193): n = g, a, c or t

SEQ ID NO: 9446 - DNA, 126 bp, Homo sapiens
aaaaagttttattgtgaaatatttatccatgagtacatataacatagatgtccagtttttcaagttacaaaaagcagacagccctccctttttttttttttttttttttttttttttttttttttt

SEQ ID NO: 9447 - DNA, 187 bp, Homo sapiens
aaattgaatcaaagacgtaagatatctctggaatctgaaagaattccaaaaaatagcacagagaaaccatttgaaagccaaatactttacattaaattggtttcacttgtcagactcccaattccataaaactggaaaatcaatttacccaggagtcagtgtattttactgtgggggaaattacttt

SEQ ID NO: 9448 - DNA, 278 bp, Homo sapiens
aaaaacacaatacttggttctaaccctggagatttcaacagggatgggaaggtaacagccatatacttttagagctgtataggttatcctgacacctctactgaaaaaaacccttgctctaacagcaattggcttcatactcttaaatgagctacctataattttaatacaaatccatgtcctaattctctttattatttttttgagacggggtcttgctccattgcccaggctggagtgcagtggtccgatcttggctcactgcaacctgcgcgttc

SEQ ID NO: 9449 - DNA, 231 bp, Homo sapiens
cctcggccgaggtgtgctttgcatttaggacacagcccggagccgcagaaggtcagcaggagcacgtctggcaccttcagtaccaggctgggtgagagagcccgagaggggggccgggggggcagtcagggccctgcttcgctgcctgggcccttgtagatggccttctccaggccgtccaccacctccctgtattccaggaacgattggtagtgtgtgcactcaaagcag

SEQ ID NO: 9450 - DNA, 332 bp, Homo sapiens
aaaatctgtttggggaacaactcataacttctttaagtaattgatgtcaaataatgcaccctgtacttctggagaacacagcattttcaaaattgctcttttcaatctaattatatcagaaaaatatcttcaagagcttagtatttcccaatttttgatcctgatcctggtaacctttcatcaagatccaagcttatgcatagggttctcatctagacccatctgaaattctatacaaatagggagacatattaaatacaaaggtctgtgtaaattgacttaattactattttacaatgaaaaggaattttattacatctttacatcatttt

SEQ ID NO: 9451 - DNA, 184 bp, Homo sapiens
  misc_feature (1)...(184): n = g, a, c or t
aaagcaganntcacaaagcacattcccaaaccncanctccctgacaggagcttgtgacaccagtgtggcctaagaatgggggatttgacttttgaaagcagaggagggaatttcgggctggatcgcaatcaggacagtcagcatgcctgcagagcacctaggctgtgagaggatggggccaagg

SEQ ID NO: 9452 - DNA, 291 bp, Homo sapiens
ccttcacaacctacgaaactacagttcagatttgggaaagcagccgaaaaaggtgcctaaacgtcgccaggccgcccgagagctgtccattcagcgccgttctgccctcaatgtgaggctcttcctcagagacttctgctctgagttcctggagaactgttacaaccggctcatgggatcagtaaaggatcacctgcttcgggagaaagctcagcagcatgatgagacctattatatgtgggccttggctttcttcatggccttcaaccgagctgcctccttccggccagg

SEQ ID NO: 9453 - DNA, 519 bp, Homo sapiens
  misc_feature (1)...(519): n = g, a, c or t
ctgacattatgactatataatgtagttagagacaatttttatcttgcttatagtaaaggttcagcctgccaattgtaaatcattctaatttggcaggcttatttttgacattggaaagggcagaaagcgatttgccccagtagtgtaataggagttatagaccagaggctgaaacccaaactatataaaaaggaattcagtggagggggctttgtaatctccattaatttgtgttgctacttccaggatcaccaaaaattacatgtaattttacatgttaaacacattgaaacataacctatgtttataaagcataacgggcttcccttccagaagctctcctgcttgtcatgaagtgagaacaatgaaaagtcatagcagatactcagtttaactctgtgtagaacctagtagtgtttgagctgttattcanatttgaattcagactgngtgttgtttgcttatggacactgcctgtcgttctgtcactgttaaattaatgagtctataagggttttc

SEQ ID NO: 9454 - DNA, 369 bp, Homo sapiens
aaaggtgctaaaatccattccatagctttgaagtgagaacttacagcccatctgaacagtgaggtttgtacccaggcatactctgaggagggcccaaaggcccagcccatctgggagggacaggcccggaggatggagacctcgcagcatgtgcaccctgcgcagacatttacagacacgcaactcagtctttctcacttggacaacctgttgtgcaaaaacactaggaatcttgaagtgagggagctctgtccacagctcccgtaatggcagggaggagagcagagcccaatgaaccttgagtgaaattaagtgctcgaataaccacataattaaattgtgcagatcagcagtcctagtctggaattt

SEQ ID NO: 9455 - DNA, 282 bp, Homo sapiens
aaagtcatgtataatatttcttgattgggaggaaatataattttatcatcatagttaacagatcttcaagagtaaaaaaaaaaaaagccatcttagtttaaggattagtttatagtgaaattgtaatttttaagaaagctgggcgttctataaaaaccttcaagaacttattaaaaattggtattttttaattctctagaaccacatagtagaatgaataacttgctaattttattcttaaaaacctcatgtttatgttttttgatttgtgtttgtatattt

SEQ ID NO: 9456 - DNA, 258 bp, Homo sapiens
gaggagccgctgagcttgctggacgacatgaaccactgctactcccgcctgcgggaactggtacccggagtcccgagaggcactcagcttagccaggtggaaatcctacagcgcgtcatcgactacattctcgacctgcaggtagtcctggccgagccagcccctggaccccctgatggcccccaccttcccatccagacagccgagctcgctccggaacttgtcatctccaacgacaaaaggagcttttgccactga

SEQ ID NO: 9457 - DNA, 272 bp, Homo sapiens
ctgaccccggcgttcgacctcagccaggatccggacttcctgactatcgccatccgcgtgccctacgcccgggtctccgagttcgacgtctacttcgaggggtctgacttcaagttctacgccaagccatactttctcaggacttcatgagacctgtgttaaatctgcagattaacccttcctggaagaattgtagaaaatggaagtgagcaagggtcctatgatgcagataaaggaatttttaccattcgcctgcccaaagaaacccctgg

SEQ ID NO: 9458 - DNA, 325 bp, Homo sapiens
ctgctgaagactcagtctctcagagagctgtgctgatggagaagccagatgtggtagtagggaccccatctcgcatattaagccacttgcagcaagacagcctgaaacttcgtgactccctggagcttttggtggtggacgaagctgaccttcttttttcctttggctttgaagaagagctcaagagtctcctctggtaaggcagagtcacttgccccggatttaccaggcttttctcatgtcagctacttttaacgaggacgtacaagcactcaaggagctgatattacataacccggttacccttaagttacaggagtcccag

SEQ ID NO: 9459 - DNA, 235 bp, Homo sapiens
gcgacccagcccgcgagcgagatgccggtggccgtgggtccctacggacagtcccagccaagctgcttcgaccgtgtcaaaatgggcttcgtgatgggttgcgccgtgggcatggcggccggggcgctcttcggcaccttttcctgtctcaggatcggaatgcggggtcgagagctgatgggcggcattgggaaaaccatgatgcagagtggcggcacctttggcacattcatgg

SEQ ID NO: 9460 - DNA, 382 bp, Homo sapiens
  misc_feature (1)...(382): n = g, a, c or t
cctttctctanaagtcctgagactgagtactctccagaggctggaggttcgtgcggagtttgtacatgtggntgagcgcnatgtgtgangaaagncccgctggtgttgatctccatcaaggncaagttntncagcttggcatgtgcctcctgcgngtctcacaaagctgtcancagacactcggagtttggctatacgagtgtcccacatatccttgaccanggtccggatttcnnntgccttcnggatgntgtctgaagnatgatttaacaggagcttcgtaagttccatgtagtaagggctgngcattgnggtaaaagnttcttcctttcgntcatgatccctcatcttntncaacttttctacatccatncnctctgga

SEQ ID NO: 9461 - DNA, 228 bp, Homo sapiens
ccaggctggtctcaaactcttgacctcaggtgatccacccacctcagcctcccaaagtgctgggattacaagcgtgagccactgcaccgggccacagagaaagtacctctccaccctgctctccgaccagacaccttgacagggcacaccgggcactcagaagacactgatgggcaacccccagcctgctaattccccagattgcaacaggctgggcttcagtggcag

SEQ ID NO: 9462 - DNA, 312 bp, Homo sapiens
ccattttcttccaataatctgtaggaatgatcaaggggtccacaccaaccctggatccttcaggaagcacactcaccagccagtcttcctgagttggtgtgtccttcagacccatcttcataagtgtccagttgctgtccatttgcttggcagcctggagaaagtagcgcccgtcagtccacatggctgcatgctcttctgtgatgatggctgtgcccgcagagccatcgaatccagagacaaaagcccgccgacagtcacatggagcaatatactcactctgatgagcatctcccgatgggatgatgtagg

SEQ ID NO: 9463 - DNA, 397 bp, Homo sapiens
  misc_feature (1)...(397): n = g, a, c or t
cctggtcacaatagggaagcgggggtggctcctcccctagcctgcaggaagcccttggtagcccacttatccaccttctcctgggtgtgtggctcancagccaagtccttgtgcactgggttgggtcccagcatgagcctggtggcctggcgggccctggcaccatggagagcagcctgctgccagtgatggcctggatctccaagacggcctccagcactgtcatgcccttgaccagctagtgctggtacaggacctgggtaacaggcatgtccttgggcgtcactggctcaggggcagaggacgaggttgaggaggaagctggatacccctgtccatggtgggctggggctggaagggtggctcantggcctcgaagtgccgggaggactcccag

SEQ ID NO: 9464 - DNA, 275 bp, Homo sapiens
ccttcttggagcccctgggcaccccgggctactgtggggctgtgggcctgttacccccaggcgcagcagctccctccggctgggcccaggctccactcagtgacacggctcaagtctacatggagctgcagggcctggtggacccgcagatccagctacctctgttagccgcccgaaggtacaagttgcagaagcagcttgacagcctcacagccaggaccccatcagaaggggaggcagggactcagaggcaacaaaagctttcttccctccag

SEQ ID NO: 9465 - DNA, 282 bp, Homo sapiens
ccaggcggtacatattctggtgcttcttagcagccttctggaagagatctcgcaggtctgctttctgcggggcagaagtaaaggggtgaagagtagccctggccctccaggcagacaggaggcagagggggcacctcacccgacgactgtgacccccacatgggcagaggacacttactgtgtgggacccctccatcatggcctgcacaaaggctgtggactcgctggtacaggaacgcacagtctcagtccgcccctcccggaacattctggtcattgagg

SEQ ID NO: 9466 - DNA, 287 bp, Homo sapiens
aaaagacctgatggggagatgaacattgcatctggctgtccccgctttgtggctcattctgttttggagaatgccaagaacgcctacattaaagatgacactctgttcttgaaagtggccgtggacttaactgacctggaggatctctagtcactgttatggggtgataagaggacttcttggggccagaactgtggaggagagcacatttgattatcatattgacctggatttagactcaaagcacatttgtatttgcctttttccttaacgtttgaagtcagttt

SEQ ID NO: 9467 - DNA, 420 bp, Homo sapiens
  misc_feature (1)...(420): n = g, a, c or t
ccatgatnccaaacaaccatatacactagttgtattctttaataagcgagtatataatattcctgtgcganttattgaancaacaaaacaatatgccttgggcagaaagaaaaatggngaagagtactttggaagtgttgctgaaatcatcaggaatcatcaacatagtccttnggttcttattgacagtcanaataacacaaaagannccaccanactgaantatgccnntaaagnttcataaagggggaaaaaaaagntcaataccattgcttcagnnactttcccaaagtttntcctttngagaaaaagtnccaaaacttcatattttggattatgaatcatccagtaatnaaatggnagatggagtnagctattgaagtggncatanatttctttttaanaagctcatgnggactt

SEQ ID NO: 9468 - DNA, 308 bp, Homo sapiens
  misc_feature (1)...(308): n = g, a, c or t
ccatttaccagactccgacacaatgggccaccaccagtgtgacagcaggacatcctaatatatggatcttgatttttaagtttcagtatctgaacttcgtaaattagtaacttttagctgggaaagtatagcatgaaaccagaggttctcagaatgactgtaagatagcttacatttcctctttttgcctttatctccccaactaaaatacaatggggaagaagtctgcctatgatctttgaatgagctttttaaggaagaaatattatatattgnttgttaaagtttattgaaataaagaatcattt

SEQ ID NO: 9469 - DNA, 358 bp, Homo sapiens
tcgaattctggtgaaaaaggaagaattgacccttgaaggaatcaaacagttttatattaatgttgagagagaggtaactgtctgattgttagacattattttaccttcttgtataagcactgtgctaaaattgcagacactaggaccatgtcttggtttttgcaataatgctagcagagtacacacaagaagaaaagtaacagcactagattgtaaagactggggtggacctctttcttaatgtccaatgtcctttgtcttaagatttggtgcaatatctcattagacctaacagaatgaagttaatttttataatttctacgttttgagactgggttatgagactggctaagactgg

SEQ ID NO: 9470 - DNA, 172 bp, Homo sapiens
  misc_feature (1)...(172): n = g, a, c or t
cctgtgggcctagctacttgggaggctaaggtgggaggatcatctgatcctgggaggtcgaggctgcagngagctgtgatcatgcctggacaacagagtgagaccgtcacttncgctctttctcggccgccattttggctagggcaggttcggggactcggtccgaggcgct

SEQ ID NO: 9471 - DNA, 356 bp, Homo sapiens
ctgagcacaaataattttccagcgccagcacaggtgtgaaaggctcacagacagacacacgcaacatgacacacccatcacttcccaagtccccagcttccccaggaacacagggcttgggctccaggccctgggcagacgaacccacagacagggctcctggttgtcacagcttgttccttggagctctcaggctgccaagggcttcaacatggtggtggaccagggagagtccacggtatagcgtctagctgatttctgccagaggatggggagggaaagagcagacacacccttggttcccgaccctgaatgagggccagcctcagtcccccagcagaagagcaccaggtcgg

SEQ ID NO: 9472 - DNA, 373 bp, Homo sapiens; identical to SEQ ID NO: 167
  misc_feature (1)...(373): n = g, a, c or t

SEQ ID NO: 9473 - DNA, 374 bp, Homo sapiens; identical to SEQ ID NO: 5632

SEQ ID NO: 9474 - DNA, 172 bp, Homo sapiens
ctggccttcctgagacaggctccattcctgttccatttgccttcccggcagccttccctttagtgggtataggttttgacgttctgagttactttgtatcaaagagctaattaaaaatggtccttcaaaaacataaagaaaaacagcttgaaaaatgtacatttctattttt

SEQ ID NO: 9475 - DNA, 387 bp, Homo sapiens
ccttttttaagtgacctgtaactcatatcagtgaaaaagaacatgctataaaaagattccacaaagtgagagcattaagctcaaaggtcctgaggtaggtgtgtttgaggagctggtgtgtagctgctgtataagaagtcaacctccttattttcaggtacatttattattattttaaccccaagcagaattgcctagctgggtccctcacctttacacaatagtcataggatttgactgttatcaaaaagtaaatccactctcagaggccatagatttcctattactgaggttcttcaaaagaatatgtaatcaatttatatagtaattcctaaaaatgagattctaaaatatagtagcatgcagatgaagcatagctaatgcttt

SEQ ID NO: 9476 - DNA, 278 bp, Homo sapiens
ccaccagtgtgacagcaggacatcctaatatatggatcttgatttttaagtttcagtatctgaacttcgtaaattagtaacttttagctgggaaagtatagcatgaaaccagaggttctcagaatgactgtaagatagcttacatttcctctttttgcctttatctccccaactaaaatacaatggggaagaagtctgcctatgatctttgaatgagctttttaaggaagaaatattatatattgtttgttaaagtttattgaaataaagaatcattt

SEQ ID NO: 9477 - DNA, 543 bp, Homo sapiens
  misc_feature (1)...(543): n = g, a, c or t
ctctgcactatgtcgggtggcctcctgaaggcgctgcgcagcgactcctgcgtggagctgagccagtaccgggaccagcacttccggggtgacaatgaagaacaagaaaaattactgaagaaaagctgtacgttatatgttggaaatctttctttttacacaactgaagaacaaatctatgaactcttcagcaaaagtggtgacataaagaaaatcattatgggtctggataaaatgaagaaaacagcatgtggattctgttttgtggaatattactcacgcgcagatgcggaaaacgccatgcggtacataaatgggacgcgtctggatgaccgaatcattcgcacagactgggacgcaggctttaaggagggcaggcaatacggccgtgggcgatctgggggccaggttcgggatgagtatcggcaggactacnatgctgggagaggaggctatggaaaactggcacagaaccagtgagtggngagagctctgtcagtgacaaacactcctttggcctgttgaatttgctgaagaacatca

SEQ ID NO: 9478 - DNA, 452 bp, Homo sapiens
ctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccaggtcctagccaatggtctggacaacaagctccgtgaagacctggagcgactgaagaagattcgggcccatagagggctgcgtcacttctggggccttcgtgtccgaggccagcacaccaagaccactggccgccgtggccgcaccgtgggtgtgtccaagaagaaataagtctgtagg

SEQ ID NO: 9479 - DNA, 208 bp, Homo sapiens
cctggagcgtttgctgtgccaggaggcggcagctcttctgggcagagcctgtccccgccttccctcactcttcctcatcctgcttctcttttcctcgcagatgataaaaggaatctggcattctacacctggaccatttgattgttttattttggaattggtgtatatcatgaagccttgctgaactaagttttgtgtgtatatattt

SEQ ID NO: 9480 - DNA, 254 bp, Homo sapiens
gacattattacaccttattaaaacttcacccagatgtccagacaaagctccatctatgtattcttctgtatttgcaagctgcatgttcatgtagccatctacagataccagatagcccttgtactccattccccacttaagtttcaccatcactggctttcctgttagtccattgaggaaaggtttgggattgaggggtaaactcatcgtaaccacggccgaatgttgcaggctactctctgccgaccaggccg

SEQ ID NO: 9481 - DNA, 203 bp, Homo sapiens
  misc_feature (1)...(203): n = g, a, c or t
ctggaccccancacctggtgctcccgtgctgagcccccagaccagtcctttcggaccggctctcccggggatgccccggagaggccgccgctttgcgactttagtgaggggctttcagccccaatggacttctaccgctttaccgtcgagagtccaagcactgttacatcaagtggcggccaccatgaccctgcagggcttgg

SEQ ID NO: 9482 - DNA, 209 bp, Homo sapiens
  misc_feature (1)...(209): n = g, a, c or t
gcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccagaagtatntncga

SEQ ID NO: 9483 - DNA, 334 bp, Homo sapiens
cctgcttcacttgcagataagtttattataattctccagaaatgtgcaggatgtgcattagcaaattgcactgtacttttcactccagcctgggtgacagagcaagactcccgtctcgggggcttaaaaaaaaaaaaatgctgtatctaaatgaatctgtgtaattgggcccagatgtgggtttgcccagtattagtagacaaggtctttgttcagacgattaggtgcctaactggcaaatgccttagtttcttaaaacgtattttctgatgtggctttacatttcaaaagtgaacttgattcaacctgagaaaactgattaaaaaattagttt

SEQ ID NO: 9484 - DNA, 243 bp, Homo sapiens
ccaccaagtaagaatggttggtgacaagacagaaggctaaaacaggaaggtaatcttgtgcacctgacaaatagaaagaataaaggatcaaaattgaaggcaggctataagagtatcaagaaattcttaaaaaccaaaaagtgatttggaagcacaaaacttacagttaatgctacccaatgtcatgatgggccaagaacattgtggcttcctaagttagaaaatgccatatgccaaaatttt

SEQ ID NO: 9485 - DNA, 466 bp, Homo sapiens; identical to SEQ ID NO: 169
  misc_feature (1)...(466): n = g, a, c or t

SEQ ID NO: 9486 - DNA, 423 bp, Homo sapiens
  misc_feature (1)...(423): n = g, a, c or t
aaaggtgtgtgtattctgtntgcatctccctgtnactgtgacacacctagatgtgtgttacttcnattaaaattctcaaatttaattttgatttgcttcagnagggacnatcgagcggccgnccgggcaggtccaatgtagctgatgtcgtgagcaaaggccagagggtcaaagtcaaagtgctgtccttcactgggaccaagaccancctgagcatgaangatgtggatcangagactgganaagatctaaacccaaatagacggcgaaatnttgncggggagaccaatgaggagacctcaatgcggaatcctgatagacccactcacttgtcccttgtnagngctcctgaagtngaggacgactcantggaacgcangcgcctcacccgaatctntgacccatanaagtgggagatnaaac

SEQ ID NO: 9487 - DNA, 429 bp, Homo sapiens; identical to SEQ ID NO: 170

SEQ ID NO: 9488 - DNA, 553 bp, Homo sapiens; identical to SEQ ID NO: 171
  misc_feature (1)...(553): n = g, a, c or t

SEQ ID NO: 9489 - DNA, 319 bp, Homo sapiens
  misc_feature (1)...(319): n = g, a, c or t
aaagtcaatctaccattaaatatacttatcttaaaattcattttgttagaaaatanaattcactttgagatctacttcttcccatattggtttattattccaataaaattcctatattcttgaatatgttttttctttctagttctgaggtatttaatttattactgaactctcttccaaatgatacacatacttgaaaaataatgagaaagaacatcttctagttanaaagattctgntnctagtaacttcaacaacagttatggaaaagaatactggaagttatccagtnaaattataagatgaaaattactatttt

SEQ ID NO: 9490 - DNA, 308 bp, Homo sapiens; identical to SEQ ID NO: 4688

SEQ ID NO: 9491 - DNA, 274 bp, Homo sapiens
aaacaagacacccaaatcagcagcaaaggtacctggggtagtcactgagattttgaacactgggaatgggagggggaaagtccaaaaagtagaagttgggaagaaaagggaaggattgagggagacgctaggctctggaggacagagctgggccgcaggaggtggaagtaagccagtatggggggtacccctcctgactgctgttgcccgtattcccccagaccccagagagccccacggtttgttctgcagtccattccctattccccaaagg

SEQ ID NO: 9492 - DNA, 83 bp, Homo sapiens; identical to SEQ ID NO: 168
  misc_feature (1)...(83): n = g, a, c or t

SEQ ID NO: 9493 - DNA, 320 bp, Homo sapiens
aaaagaattaaccattggaatgaatggcatggaaccaactaatcagaatggaagacagccctggcactggagtaggatcatagagaacttctgcttgcttggccttcagcttttaggtttttggatcatggagagtttaaggagtcctgggagagggccagggagcctgcagttgtagcagggctcagggctgtggctttttaccaaatggtacagaaatagacaaattataacccccacatggctgaatcagttcatactgaccagcatgacccaaacccttttatcctaaaggatctccccacgagagtgttttggac

SEQ ID NO: 9494 - DNA, 260 bp, Homo sapiens
  misc_feature (1)...(260): n = g, a, c or t
ctgtggcccccanggctaccctacacaacgccctccccaggcccccctaagctgctctcccttggaacctgcacagctctctgaaatggggcattttgttgggaccagtgacccctggcatggggaccacaccctggagcccggtgctggggacctcctgggcaccctgtccttcactcctttgccccagggacccaggctcatgctctgaactctggctgagaggatgctgctcaggagccagcacaggacaccaccac

SEQ ID NO: 9495 - DNA, 481 bp, Homo sapiens; identical to SEQ ID NO: 173
  misc_feature (1)...(481): n = g, a, c or t

SEQ ID NO: 9496 - DNA, 110 bp, Homo sapiens; identical to SEQ ID NO: 174
  misc_feature (1)...(110): n = g, a, c or t

SEQ ID NO: 9497 - DNA, 430 bp, Homo sapiens
cctagagagtcatatgtctcagttcagaaatctatcgaagtggcagagctggaattcaaacacaagcagccgttctctgctattccaccctggtgtccaagcaacatggtagggcagaaggaagaggatcttacaaagagtaagggaaagggagaggggcagaggctgcttctcagagccaccaaaggacaaaataagacaggtgtgagcccagtggaggaggcacggggcagagaccagccactgttgctggcacgctggtgcacgtagcactgtggcagatggacctggagaggaagcaggagggacagcacaatggagccaagaaaggacttagcatggccgggcgcggtggttcatgcctgtaatcccagcattttgggaggccaaggtgggcagatcacctgaggtcaggagtttgagaccagcc

SEQ ID NO: 9498 - DNA, 403 bp, Homo sapiens
  misc_feature (1)...(403): n = g, a, c or t
aaaaaatggtatttcagtatacagtcatccctcgtcatcagcggtgtgtggggcggcgggggcggttccagaacccttcccagatactagaatctgcagatggttaagtcctgcagttggccctgtggaatctgtggattagacaagttggccctccctatctgcaggttccacatccttgaatactctgttttccatctgaagttggttgaagccatggatatggagggctgactgtcgttggttttgttttttttttttttgatagacttcattttttttttttatggnaatattaggtgcatagcaaaatanagnggaatccaagagagttcccatatacttccagtcccctnacacacaagcctccccaactaccagcagnctgcaccagagtggtaca

SEQ ID NO: 9499 - DNA, 530 bp, Homo sapiens
ctggttccgccctatgcggactctgcccatggaacccggccctggaggctcagagggacggggaccagaggaccagggtccccccttggtgtggactgagattgcccccatccggccggaatccagtgattcaggactgggcgaaggagactctaagaggaggcgcgtgtccccctatccttccagtggtgacagctcctcccctgctggggccccttctccttttgataaggaagctggaggacagttttataactattttcccaactgagcagatgacatgatgaaaggaacagaaacagtgttattaggttggaggacaccgactaatttgggaaacggatgaaggactgagaaggcccccgctccctctggcccttctctgtttagtagttggttggggaagtggggctcaagaaggattttggggttcaccagatgcttcctggcccacgatgaaacctgagaggggtgtccccttgccccatcctctgccctaactacagtcgtttacctggtgctgcgtcttg

SEQ ID NO: 9500 - DNA, 146 bp, Homo sapiens; identical to SEQ ID NO: 338
  misc_feature (1)...(146): n = g, a, c or t

SEQ ID NO: 9501 - DNA, 304 bp, Homo sapiens
cctcaggaaacttacagtcatgacagaaggggaggcaggcatgtcccacatggtggagcaggaggaagagctcacctacagcaaattatttaagaccgagcatttgtctctgttctgttccctctctggacgcaccctcctgcctccaccctgacttgccgtctcctgagcactgaagatatttttggcttgtccgatgtgactccacagacagcagaaacgcttgcttgatcagggcagcatcagggcaccacacatgcctgggcttgcacaacacagtgggagcactgccactcagcagcag

SEQ ID NO: 9502 - DNA, 312 bp, Homo sapiens
aaaaatcctatattaatccttttataagtgaacagtcacttaaaaatctcagctttcataattgggttgattaagtaacttatatctgctgtataataaacatagcgatcacagactatcctttttttccatattttataactctgaaactgagctctttactgttgattatccaaatcttttgccttttttctattagcaccctgcccatttcactactctaatcagccaatcaagagataaaatgagtctgggcttggtggctcatgcctgtaatctcagtactttgggaaaccgaggcaagtggatcag

SEQ ID NO: 9503 - DNA, 421 bp, Homo sapiens; identical to SEQ ID NO: 172
  misc_feature (1)...(421): n = g, a, c or t

SEQ ID NO: 9504 - DNA, 427 bp, Homo sapiens
  misc_feature (1)...(427): n = g, a, c or t
ccttgcctcanatccaaggtcactcngaagaggccatgnntaccctcaatgacactcatggaggaaatgctgaganaagcattcagatgcatnacacaaggnnagactgccnaaaatcttgnnncttgctctcctnatttngntatttgtnttatttttagganttttgagagcaaaatgacaacacccagaaattnagtaaatgggactttcccggcngagccaatgaaaggccctattgctatgcnatctggtccaaaaccactcttcnngaggatgtcttcactggtgggccccacgcaaagcttcttcatgagggaatctaanactttgggggctgtccagattatgaatgggctcttccacattgccctgnggggtcttctgatgatcccagcagggatctatgcacccatctgngngactg

SEQ ID NO: 9505 - DNA, 350 bp, Homo sapiens
  misc_feature (1)...(350): n = g, a, c or t
ctgggaacaactttcttnaaactacctggnggtgaacttaacccaggagaagatnaagttgaaggactaaaacgcttaatgacaganatactgggtcgtnagganggagttttgcaagactgggtcattgacnattgcattggtaactggtggagaccaaattttgaacctcctcagtatccatatattcctgcacatattacaaagcctaaggaacataanaagttgtttctggntcagcttcaagaaaaagccttgtttgcagtccctaaaaattacaagctggtagctgcaccattgttngaattgtatgacaatgcaccaggatatggacccatcatttctagtct

SEQ ID NO: 9506 - DNA, 343 bp, Homo sapiens
ctgtcttccacggtacctgaactgggtctgattttttgaaacattttggaaaagagattgcgtttggaatgtttacatttcatgtgacaacatgaaaacaataaactgaaatgtcacctgaatgtgtagtaggagtctccctgtgtttaagtaactggtgtatcaaattgaatacttaagactgacactgttaaagtacccttgactgcaatagaatttgatggaagatctcagggaagtggaacaaaatcttgtatgaaaaataaggaagtagaaagaaggtctaagtctgaatttcatcccaggggttttcccttttctgaaatgttaagggctcctttgg

SEQ ID NO: 9507 - DNA, 237 bp, Homo sapiens
ccttggcggggctggcacctctgtgtcatgggagactctgtcccaggctctctccctgctgctgggctttgccggccgtctctgctgctcttggcttatggaagcagcaccatcttcacagggcgttctccccacgtgctgtctgtgcccagattcccccttttcatgaggacagcagtcatattggatcagaggcttgcgctactccagggtgacctcatctgaacttgattgcag

SEQ ID NO: 9508 - DNA, 432 bp, Homo sapiens
aaatgtatatggttaaacagccaatttagggaagaggaaataacactatatccagacaagcatgggtgtgtccgggacctgttagaagaatgtaaaaaggccgtggagcttggggagaaagcatcagggaaacttaggctgctagaaattgtaagctacaaaatcattggtgttcatcaagaagatgaactattagaatgtttatctcctgcaacgagccggacgtttcgaatagaggaaatccctttggaccaggtggacatagacaaagagaatgagatgcttgtcacagtggcgcatttccacaaaggggtcttcggaacgttcggaatcccgtttttgctgaggatacaccagggcgagcattttcgagaagtgatgaagcgaatccagagcctgctggacatccaggagaaggagtttgagaagttt

SEQ ID NO: 9509 - DNA, 552 bp, Homo sapiens
  misc_feature (1)...(552): n = g, a, c or t
cctggtctgagcaagggcagccccctgtcccanacacaggcacccccaatctcactttggacagagccaacgtggggggatcctcccgggcctgggcctgtcaagtctgcctgcgggaccctgccattgtgctcaaatcacaaccattttgtgcttccaacatttagggtgcttgtgcantgagtggagctgggggcctgccccctaacatggaccttggacatccctgaaagagtgggcagagaatccaactctcatgaagcacaactcggggtgtctcatggatgttgggctcagggctcctgaaggacttcaagtttagagagtcaatgacacttgccaggacagcaganctggccccgccgtgaggtagctgacccatcagaaacagcnnaaaatgggcatgatgatgagcacctntcgcagggccataagatcacacttcgtgcaagaacacgccttgcagctacagtgcagtcaccccaggtggggcatccccggcccgggggtgggagctnaaggggacagagtcttacgtgtttctatcgcttg

SEQ ID NO: 9510 - DNA, 252 bp, Homo sapiens
cggggtgatcatggacgcttgacaacctgcgggcaggcgccgggaggccgagccagcgactaagaggaccgagaggtggcgtggacagatttcaaggccagagaatggcaggggaacagaaaccctcaagtaatctcctggagcagtttattttactagccaaaggtaccagtggctcagccctcactgctctcataagccaggtcttagaggctcccggagtgtatgtctttggagaacttctggagctgg

SEQ ID NO: 9511 - DNA, 438 bp, Homo sapiens
  misc_feature (1)...(438): n = g, a, c or t
ccacctccccatatcctgagactgacagngttttttttgagccttcccatctgacatctgctgctgatgaaggtgctgttcaagtcagtagaagaaccatttcttcgaattccttctcaccagaggtatttgtgctgcctgttgatgtagaaaaggaaaatgcccacttttatgttgcagatatgattatatcagcaatggagaaaatgaagtgtaacattctgagtcaacagcagacagagagctggagtaaagaagtcagtgggttacttgggagtgatcagcctgactctgaaatgacttttgataccaacataaagcaagagtctgggtcttctacttcttcatacagtggctatgaaggttgtgctgtgttacaggtcagcccagtgactgaaacacgtacttaccantgatgnngcctaatgagtgagctaa

SEQ ID NO: 9512 - DNA, 395 bp, Homo sapiens; identical to SEQ ID NO: 339
  misc_feature (1)...(395): n = g, a, c or t

SEQ ID NO: 9513 - DNA, 372 bp, Homo sapiens; identical to SEQ ID NO: 175

SEQ ID NO: 9514 - DNA, 292 bp, Homo sapiens
  misc_feature (1)...(292): n = g, a, c or t
ctgaccatgaaggacagcaaccagttccacgccacctgcctcgacaccttcccgcccatctcttacctcaatgccatctcctggcgcatcatccacctggtgcaccgcttcaacgcccaccacggggacaccaaggtggcgtacacctttgacgcgggccccaatgccgngatcctcaccctggacgacactgtggctgagtttgnggctgctgtgtggcacggctttcccccaggctcgaatggatacacgtttctgaaggggctgcaggtgangccggcccctctctcag

SEQ ID NO: 9515 - DNA, 373 bp, Homo sapiens; identical to SEQ ID NO: 176
  misc_feature (1)...(373): n = g, a, c or t

SEQ ID NO: 9516 - DNA, 247 bp, Homo sapiens
ctgccatgttcacatatcggtccctctcccttcagggtccacagagggaccctcagcggctttctcttctctgtcccagctccccagcagccacagcattcgccagggtgacctcggtcagacggcgccactcacccatcacgagactagaaccaccgcactcccaagacagccttgttccttggagctcaggatcagaagggcaacaaggacacacacatgcacttaccaaggtggctgtgcctgg

SEQ ID NO: 9517 - DNA, 146 bp, Homo sapiens
  misc_feature (1)...(146): n = g, a, c or t
ttcagggatcttgaactgaanaaaatangtctgggaaagaacagtnctggctcaaatgtttcatgttcattaatctatgaaacctttattaaaccagtactgngtatcaggcacatgatttcctaaaggagaaattttaacatttt

SEQ ID NO: 9518 - DNA, 154 bp, Homo sapiens
ccttgttcaaaatccaagctgagggtggcactaattccaattagaatggcaagagtcatgccaaggaccagcaccctaagagtgtttctccccgcataccaaagcatcactgcaatgtgcagaagagctgataacggtaggattttgtaaccag

SEQ ID NO: 9519 - DNA, 329 bp, Homo sapiens
ccatggagaaggaggaaaaagagagtcccttctccagtgaagaggaagaagaagatgtgcctttggactcagatgtggaacaggccctgcagacctttgccaagacctcaggcaccatgaataactacccaacatggcgtcggactctgctgcgccgtgcgaaggaggaggagatgaagaggttctgcaaggcccagaccatccaacggcgactaaatgagattgaggctgccttgagggagctagaggccgagggcgtgaagctggagctggccttgaggcgccagagcagttccccagaacagcaaaagaaactatgggtaggacag

SEQ ID NO: 9520 - DNA, 126 bp, Homo sapiens
ccacttctgccacccccacccctttaagacactgaaacatgccggacagcagattcacaagtgaagagcaggaaacagggtttgaggatagtggttaaccatggctgcattcttctgggagccttt

SEQ ID NO: 9521 - DNA, 215 bp, Homo sapiens
ccagctctgtgggaactatacagggagctgggcctatttcagggcccagcactggggctgaggaaccatttgggaagaaaactaagaaggagaaaaaagaaaaaggcaaagagaacaacaaactggaaggtactttggggagatgatatcagttgccccagtgactcacctactaatgacagttagacctggtactaactgacagacacacacag

SEQ ID NO: 9522 - DNA, 122 bp, Homo sapiens
  misc_feature (1)...(122): n = g, a, c or t
gatattgttaggatctactagcaaatgatttggtaacctgacatctttgtattcatgtccaaaaaaattcttttataagaacaaaaatgntactcttagcctcattcactgnagnattactg

SEQ ID NO: 9523 - DNA, 286 bp, Homo sapiens
cctagaaaaatgcctggcacagaagcatttactaaatatttgttaaatggatgaataaactatgtgaccagaattccttaatactgggtccgagactagaaagtgggagttactggtttggttttggcacttgtttagtcagcttgtgctgccataacaaaacaccacagatggattggttaacaacagacatttctttctcacaattctggaccctggaaatctgaggttagggaaccagcagattcagttcctggtgagggccctcttcctgcctggcagacag

SEQ ID NO: 9524 - DNA, 518 bp, Homo sapiens
  misc_feature (1)...(518): n = g, a, c or t
aaaaataaagtctccctacttaaaatccagtagatatcatggcactaatgctaacacccctttccccaaattaataaaacaaaaataaaaaaaagaaaaagagaaaagagaaaagcaaggtggttagccctccctcctgaaaaaaaccttacaatggtagtgctggaaaaggaagttgcccttgattaaaaaggtaacaaaattcccacattgtacaaatcggttccagtatagcaagaggtgagggctagggcagaggagcaaactatgtacaaggacccattgaaaacgcagtagtaggactttggcactatgaacaattcccaccggtcctctgggaggtgcgtctgagagtcgctggacttcccgcaccctccaggcacacgcgagctaagtagttccacttggagtcactggcaagggtggcccatggctggggagagaccatctcttctttcttcaaagacggagcgtcccgttgatcagcacagcagtnctaacagacttccctgtctagg

SEQ ID NO: 9525 - DNA, 226 bp, Homo sapiens
ccccctagaggtgtccctgtgcctgtctgctgtccaaggcaagtgccacacacagccttggagttaccccagtgtgtgtctttcctctctgaggctgtcggtgctgatgacaacactgggacccataggtcccagcaactccctgagtgacacatcccctcctgtgcagtgtggcagaggagtgctgagttggcttggacctgtccaacctcgtctggcctcattt

SEQ ID NO: 9526 - DNA, 274 bp, Homo sapiens
ctgattgccaggtgaacatcaccatcttactcctctgaataactagacacaaattacatagcaagttcgagtttctgcccacccaagacacagccagtaatcagtcacaaacacagacacagccaactccaggggctccagctttctgcccatcttctctcagcagttcctcccatctgctaagatgcgccttcctggtggctctctctcaaggtgggtcaaggctgaacaagacagaaaagcacagtctaggtccaccatcacctcccactgg

SEQ ID NO: 9527 - DNA, 376 bp, Homo sapiens
ccaaaggcagctctggcatgctcaaaccctccaacctgtagccgcttcttgaagaggtccagcggatatgtcagggtcttgctgatgacaccagctccactgccacaaagcaggttttggaggttctcatttttctttccttcggctggtatggcccacttgtacaggtgcttcaaggagctgtagcaagagaactgcagcccggcgtaggggaagatggcgatcaaggtgggagccaagcctttgtagaaaacctgggggccttcgctcctatacatggtccccacggcgtggcgcagcgtattatagaccttgggctcaccctgagctgcaaagcgggtgcgcagaacatccacggggtgcacagtgagggtgg

SEQ ID NO: 9528 - DNA, 220 bp, Homo sapiens
ctgggggatgttactgccttgtgccagttccccaagctcgaggaactcagcctggagggcaaccccttcctgacggtcaatgacaacctgaaagtctcctttctcctgcccacgctccgtaaggtcaatggcaaggatgcgtcctcaacttactctcaggtggagaacctgaatcgggagctgaccagcagggtcacagctcaccgggagaagttcatgg

SEQ ID NO: 9529 - DNA, 425 bp, Homo sapiens
  misc_feature (1)...(425): n = g, a, c or t
gaggtagggntngcaatgagctccacccttcagccatgtcctgcaaccttccccgggcccatagtgagggtgccaccttactcccagcctccangggctctgcctgctcctgccctgtcccccgcatcctatgaggcatgggcgtgggtgggcacagcatactgtgcgtgtgngtgtccgtcacaccttgctcgggacggaaagattcccacacaggaataaggacccgtggccctcatgggggaaggacagaggcactacaggtcacctcatcccctctcctgcctccatggcacacgtcaccctccccaggccacttccaagtcactcagagttgtgggacagagngaagctctctgcatggcgtttccttggctatggnttgcagaggctgcaaactccaatgagctacagtttgggggcag

SEQ ID NO: 9530 - DNA, 450 bp, Homo sapiens
  misc_feature (1)...(450): n = g, a, c or t
ccttgcctcanatccaangtnactcggaagaggccntgtctaccctcaatgacactcatggaggaaatgctgagagaagcattcanatgcatgacacaaggtaagactgccaaaaatcttgnncttgctctnctcattntgtnatttgttntatnnttaggagttttgagagcaaaatgacaacacccanaaattcanntaaatgggactttcccggcngagccaatgaaaggccctattgctatgcaatctggtccaaaaccactcttcaggaggatgtcttcactggtgggccccacgcaaagcttcttcatgagggaatctaagactttgggggctgtccanattatnaatggnctcttccacattgccctggggggtcttctgatgatcccancngggatctatgcacccatctgtgtgactgngtnntaccctntctggggaggc

SEQ ID NO: 9531 - DNA, 242 bp, Homo sapiens
  misc_feature (1)...(242): n = g, a, c or t
ccagcaatctgcctgagcagttcgactgtgccatcaacanccgcattgacgtgatggtccacttcgacctgccgcagcaggaggagcgggagcgcctggtgagactgcattttgacaactgtgttcttaagccggccacagaaggaaaacggcgcctgaagctggcccagtttgactacgggaggaagtgctcggaggtcgctcggctgacggagggcatgtcgggccgggagatcgctcag

SEQ ID NO: 9532 - DNA, 271 bp, Homo sapiens
aaagtttgctgtgtttgtaaccagtgtgtgttgagaaggaccaacaccaaaccaccctggggaagggggacagggaaacatttaacacagacgatgatcaggatttgccccaaaccaccccaagagagaggactgagtggaacaaaaaagtgacccccagaacctctcttagtgtgagggtgggtagaatgagaactgacacctgggagctgtggggagcagagcggctttggggaagagtggagtgactagacacctaatgccctggcag

SEQ ID NO: 9533 - DNA, 373 bp, Homo sapiens; identical to SEQ ID NO: 177

SEQ ID NO: 9534 - DNA, 409 bp, Homo sapiens
tcgggagggaggaaggtggcaagatggtgttggaaagcactatggtgtgtgtggacaacagtgagtatatgcggaatggagacttcttacccaccaggctgcaggcccagcaggatgctgtcaacatagtttgtcattcaaagacccgcagcaaccctgagaacaacgtgggccttatcacactggctaatgactgtgaagtgctgaccacactcaccccagacactggccgtatcctgtccaagctacatactgtccaacccaagggcaagatcaccttctgcacgggcatccgcgtggcccatctggctctgaagcaccgacaaggcaagaatcacaagatgcgcatcattgcctttgtgggaagcccagtggaggacaatgagaaggatgtgagtccaagtggcag

SEQ ID NO: 9535 - DNA, 396 bp, Homo sapiens
ctgctgggggaagcagcttgttcaatgggagaactgggctgtgaagtctgaccagactgggctcaaaccccctctctgccacattctagcaaggcgtttaggctttgagcctcagtgttgccacctgtgaaacgggtgacactatgtcacagactgcagggtgaggttgtggaaacgcccagcatggaccgggacacaggcggcgctccatgaagcttccttggctccctctctaggtggtggtcagcgtccctcagaggatcatggcccgtcacctccaccccatccagacaagcttccaggaggctacagcctccaaagtgattgttgccgtgggagacagaagctctaacctgagaggcgagtgcacccccacccagagggaagtcatccagg

SEQ ID NO: 9536 - DNA, 155 bp, Homo sapiens
aaatgttcatttaacttagttttgtttagctagttaaaacacactagcatttgtctagtttcctcatctggatgaggaaacctgctgtgatggcagtgataaaatttttccttttaggaattttgcaaataaaccactgcaattatagacacttt

SEQ ID NO: 9537 - DNA, 613 bp, Homo sapiens
ctgaggcttggaaacgtttcttgtgttgccctgaaaaatctttgagacctcagggaggctctgtctctcttaaaaggtggagaaagatgccattctctccctaaggtctggtggagtctccccatcttgcatacccttctgcaagccatctatctctgctcactctccaattgacccgcctgggaacaagggatgaggaggagttgggggctggggggaatcctgccagttggtgaagccctgtggcaggaaggtatatgtggacatagagtatacctgactctctttcttcagccactgactgcttgggttgggctgtgaatgataatggaatggctggagtctgctgttgtcagaaggcagggagggtgatgaaggactgacccacatggactgggatgtgtgtcggttatgggcatgactgcacgttcactctcagtgggatctgggcaacatggagttcattgtcctgttgcttacttactgcaatgtctttggccctccttttcaactggttcctctgttgggcccaaaggttgggagtaggagacagtatcccaggctgacaagggcttgccctttaccttgggcaccttgttaatttttagcctgt

SEQ ID NO: 9538 - DNA, 422 bp, Homo sapiens
ccaggggagggctccatggttctttagcacaggctgtggcctcacacactccagtctccatggtaacccaagcactcaggctattatgtcccacacctcctcgctggcctgcttctgtcaactctacgctggtagaagatctcggcattagctgtctggggaagctaacttcctacagtgggttttagttgagttaatcaccactggtgtaaaacgcttgtgcatcttaggaacccaaatcttccccaaattctagacaatcccacaaaatgctagtatctaggtttagatctaggtcctgtcttccgtttgaagccttcagggtaaaggagggcagagataaggctctctcctggggaaaggagttctacacaaaaatgacctcagaatgggggccattagcctcaagcatctgtgtgagg

SEQ ID NO: 9539 - DNA, 362 bp, Homo sapiens; identical to SEQ ID NO: 6999

SEQ ID NO: 9540 - DNA, 336 bp, Homo sapiens
aaaattacaattgaagtaaaataatgtgtcttatttcagtataaaggatcatttgaaactgttgattccaaacatcaactaatattatatagtcatcagtagaattataaggatgccatatcatgacattttagaagtggagagtgcatcatatgtagaaaataaatattcagacgtggctcattaatgttactaagttggaagtgagaatttatgaacattaattcattttaagaaaagtgcagccaggcgcagtggctcatgcctgtaatcctagcactttgggaggccaaagtgggcagatcacctgaggtcaggagttcaagaccagcctgg

SEQ ID NO: 9541 - DNA, 490 bp, Homo sapiens
ccagcaaacttgaggctcctttcactcaggatgacacccttggactggaaaactcacacccggtctggacacagaaagagaaccaacagctcatcaaggaagtggatgccaaaactactcatggaattctacagaaaccagtggaggctgacaccgacctcctgggggatgcaagcccagcctttgggagtggcagctccagcgagtctggcccaggtgccctggctgacctggattgctcaagctcttcccagagcccaggaagttctgagaaccaaatggtgtctccaggaaaagtgtctggcagccctgagcaagccgtggaggaaaaccttagttcctattccttagacagaagagtgacacccgcctctgagaccctagaagacccttgcaggacagagtcccagcacaaagcggagactccgcacggagccgaggaagaatgcaaagcggagactccgcacggagccgaggaggaatgccggca

SEQ ID NO: 9542 - DNA, 526 bp, Homo sapiens
aaacatcatccttgtcttgtgaagaaaacaggaagaatgtcatgtaccatgtggatcaccttcagttcaaagttgcagcaaagtgaagaaagaaactactggaagccacccagcaatgcactgtttagtcatcaattaggagcccatgggaggataatagggagactgggtggaggctcagtgtgtaataatctcttgtctaatgtatgtgtgtcactgccatgttgtatgaacaatagtgagggctcacatttacttaacacttgtgtgcgcaaatctgggttcttcttcctttccagaactatgactcgatcataaaatctgttttgtttgcatgcatgcccaaaacaaccctgtaagtagaacattgtcattatctctgttttagagatgaggaaacaggctcagagaagctcagaaatttgttcaagatcgcacagctagtaaatggcagaagtaggattgtgaacccagggaatctccagagcctctgtgtaaccatgatgttatattttttttcctcttt

SEQ ID NO: 9543 - DNA, 327 bp, Homo sapiens; identical to SEQ ID NO: 179
  misc_feature (1)...(327): n = g, a, c or t

SEQ ID NO: 9544 - DNA, 192 bp, Homo sapiens; identical to SEQ ID NO: 180
  misc_feature (1)...(192): n = g, a, c or t

SEQ ID NO: 9545 - DNA, 171 bp, Homo sapiens; identical to SEQ ID NO: 181
  misc_feature (1)...(171): n = g, a, c or t

SEQ ID NO: 9546 - DNA, 318 bp, Homo sapiens
aaagaaattggagatattgctggtgttgctgatgttacaatcagacagtcctatagactgatctatcctcgagccccagatctgtttcctacagacttcaaatttgacaccccagtggacaaactaccacagctataaattgaggcagctaacgtcaaattcttgaatacaaaactttgcctgttgtacatagcctatacaaaatgctgggttgagcctttcatgaggaaaaacaaaagacatggtacgcattccagggctgaatactattgcttggcattctgtatgtatatactagtgaaacatatttaatgattt

SEQ ID NO: 9547 - DNA, 301 bp, Homo sapiens
aaagaaggggacaaagctgaaccagccacttggaagacgaggttacgctgtgctttgaataagagcccagattttgaggaagtgacggaccggtcccaactggacatttccgagccatacaaagtttaccgaattgttcctgaggaagagcaaaaatgcaaactaggcgtggcaactgctggctgcgtgaatgaagttacagagatggagtgcggtcgctctgaaatcgacgagctgatcaaggagccttctgtggacgattacatggggatgatcaaaaggagcccttccccgccggagg

SEQ ID NO: 9548 - DNA, 136 bp, Homo sapiens; identical to SEQ ID NO: 178
  misc_feature (1)...(136): n = g, a, c or t

SEQ ID NO: 9549 - DNA, 220 bp, Homo sapiens
cctgggatgcagggagaaaggctgaccacaagttgagacaagatacagaaacaaacaaaaacagcagaaagtccgatcgatggtgtaagtgttgtgttcactgcttagggtgcaggtgagcttgatcgaggctcccagtaaggcagatgtagacgggggctgagtcagcacaggcagagcacagagacctgtggagaaaatgaagggcagtaggtagaag

SEQ ID NO: 9550 - DNA, 373 bp, Homo sapiens; identical to SEQ ID NO: 182

SEQ ID NO: 9551 - DNA, 181 bp, Homo sapiens
ggcctgggcaggtttcatggtcctgctgatgatcccatggggctctgctgcaaaactggtctgctacttcaccaactgggcccagtacagacagggggaggctcgcttcctgcccaaggacttggaccccagcctttgcacccacctcatctacgccttcgctggcatgaccaaccaccag

SEQ ID NO: 9552 - DNA, 297 bp, Homo sapiens
ctggagcccttccctgagaaactcttacaggccaggaagccagtacagacctttgagaggtctgtgtacagtgacaggtatatctttgcaaagaatctttttgaaaatggttccctcagtgacatcgagtggcatatctatcaggactggcattcttttctcctgtgggagtttgccagccggatcacattacatggcttcatctacctccaggcttctccccaggtttgtttgaagagactgtaccagagggccagggaggaggggaaaggaattgagctggcctatctagagcag

SEQ ID NO: 9553 - DNA, 583 bp, Homo sapiens
ctgtgcattctctcctgactcttctatgctgtgttcagtcggagccagtaaagcagttttcctttggaatatggataaatacaccatgatacggaaactagaaggacatcaccatgatgtggtagcttgtgacttttctcctgatggagcattactggctactgcatcttatgatactcgagtatatatctgggatccacataatggagacattctgatggaatttgggcacctgtttcccccacctactccaatatttgctggaggagcaaatgaccggtgggtacgatctgtatcttttagccatgatggactgcatgttgcaagccttgctgatgataaaatggtgaggttctggagaattgatgaggattatccagtgcaagttgcacctttgagcaatggtctttgctgtgccttctctactgatggcagtgttttagctgctgggacacatgacggaagtgtgtatttttgggccactccacggcaggtccctagcctgcaacatttatgtcgcatgtcaatccgaagagtgatgcccacccaagaagttcaggagctgccgattccttccaagctt

SEQ ID NO: 9554 - DNA, 498 bp, Homo sapiens
  misc_feature (1)...(498): n = g, a, c or t
ctgtgaactgcttgttagcnntcttcanggtgcctttcgagaaataatacaccttgttcacttcaataagaggaaagaactngtccacttgctcatngaaanctgtanctcggatttcaccactttngtcaaccagntctagggagaaaagcttcccttnccctcnggagtngctccaggtacngatctgacttttgttggtaacacnancacaaatggnccacttggactggnaaggagtgaggctggcantgggcaccactttggactgngtncccccagaagtgtgtgacaggctgggacctgcagctttnccaaatgtctttgaagcaccatangccttanaaacagtnnaacccattcccgagcttncattctgcggctggggcctgctgcttgctgctgggctggctgctggcgctggaggagctacttgcggctgcccgagnccttcattatagggcactggattgccaatcttcactncaactgcttcag

SEQ ID NO: 9555 - DNA, 585 bp, Homo sapiens; identical to SEQ ID NO: 183

SEQ ID NO: 9556 - DNA, 349 bp, Homo sapiens; identical to SEQ ID NO: 640

SEQ ID NO: 9557 - DNA, 127 bp, Homo sapiens
ctgtatcaaatgaaccgagttggaggaaattgtataggagtatatcttaatggcactacagcaaactgtgttaaatttgggtttttggcaaagattgaagaaaactggtattcaagatgtactgcag

SEQ ID NO: 9558 - DNA, 389 bp, Homo sapiens
aaaggaaaaaaaaagttcagtcagaagttgaatgtccccataaggagtaacagaggtcattcctgattaatctaatttaatctttataattcaaggatcctcccagccaaaacaatctcaggtatccgattttatgcaattcattttgtgagtaacatcacagaaggattgagtaggatactggtttaaccatgggcataacattttttttttcagtattgaagagtaaagctaaagtttgttcactaagatgtttaattcaagccccagtaacagagatacacaactgccaaagtcagctcttaggggtgttgtaccaggaggtggtgtaaacagatctggacccagagaattagaaagaaaaggcagaatgaagttcacaacagcag

SEQ ID NO: 9559 - DNA, 337 bp, Homo sapiens
ctggctgatgtctgcttggacactccactctgtaatgggcacaccacagggatggatgtcctctgggcagggacccccatggtgaccatgccaggagagactcttgcttctcgagttgcagcatcccagctcacttgcttaggttgtcttgagcttattgctaaaaacagacaagaatatgaagacatagctgtgaagctgggaactgatctagaatacctgaagaaagttcgtggcaaagtctggaagcaaagaatatctagccctctgttcaacaccaaacaatacacaatggaactagagcggctctatctacagatgtgggagcattatgcag

SEQ ID NO: 9560 - DNA, 584 bp, Homo sapiens
  misc_feature (1)...(584): n = g, a, c or t
aaaagttataataataaatacccacacatgtaattatacattctaggctgggagtgggggctcacacctggaatcccagcactttgggaggccgaggccggtggatcacctgaggtcattgggagttcgagaccagcctgaccaacatggagaatccctgtctctactaaaaatacaaagttagccaggcatggtggcacatacctgtaatcccagctacttgggaggctgaggcaggagaatcacttgaacccgggaggtggaggtagtggtgagccgagattgtgccattgcactccagcctgggcaacaaaagcgaaactccgtctcaaaaaaaagttacacattcgttcctattatccttgccgtaaataaatgtgacaaagctgaggctgatcctgagaaagtgaaaaaagagctgctggcttacgatgtggtatgtgaagattatggaggtgatgttcaagcagtgcctgtctccgcacttacgggcgataatctgatggctttggcagaagcaacagttgctcttgcagaaatgttagaattgaaagcagatcccaatggtncagtggaaggaacag

SEQ ID NO: 9561 - DNA, 255 bp, Homo sapiens
cctggatcccggcctttccctgtgacttacgtgtctgtcaccggcaggcagccctacaaatcctggtgacctgctctcccaagaacagagcctgtccccagatgtcccagtagcgatgagtaacagaggtggctgtggacttcctctacttctccttgctggatcagggccttcctgcctcccgctgggcaggtctggccttgctctcttggcagggccccagcccctctgaccactctgcagctcaccatgcag

SEQ ID NO: 9562 - DNA, 357 bp, Homo sapiens
aaatacacagacgggcgagtggcgcccgtgtcgatgtcttcagccagtggtgaccctgcttttgtaaccgcgtcaacctgacaaaacctcagcagcagaagtccctatttttctaggagttcatcgtgcagacagtcttcactacaggactcggccctggggcctctgcctctcgtctgaccttgcagccttagtcgttggaggctggagcgcaatggccctgccgtctgtggagcctctgggcggccttctttcctttctgtcaacctctcatttcacagaaaaaggctgaatttcattttttccagcatgaaagccaggatcggttagtggttggattctattggtttttttttt

SEQ ID NO: 9563 - DNA, 155 bp, Homo sapiens; identical to SEQ ID NO: 184
  misc_feature (1)...(155): n = g, a, c or t

SEQ ID NO: 9564 - DNA, 248 bp, Homo sapiens
aaaaatgttagagctgttttacaattattttcacttccctagctttctgagcctgtaagtctctcttccctatttcaacattcatcctaaagagttttcaattagtatgtgaaaccaaaaggtcagagtgttttagtctgatacaaatcatccctaactaaaatgattccagtatgtgcttccatttcattaaaactgttctgtgaaaatttggatatcctcaggaatgcattattacagaataattt

SEQ ID NO: 9565 - DNA, 257 bp, Homo sapiens
gtgaaatcatacaggaagtgggaaaactctatccactggagatagtatttggaatgaatggaagaatatgggttaaggcaaaaaccatccagcagactttaattttggcaaacattttagaagcttgtgaacacatgacgtcagatcaaagaaaacagatcttctccagattggcagaaagttgatataggtggacttttttacaggtcagttgaggcaaaaaactatgggttttttcaggtgaacctcccccattt

SEQ ID NO: 9566 - DNA, 119 bp, Homo sapiens; identical to SEQ ID NO: 185
  misc_feature (1)...(119): n = g, a, c or t

SEQ ID NO: 9567 - DNA, 579 bp, Homo sapiens; identical to SEQ ID NO: 340

SEQ ID NO: 9568 - DNA, 460 bp, Homo sapiens
ctgtgccaggctgtcaagttcctccatgataacaagctgacacatacagacctcaagcctgaaaatattctgtttgtgaattcagactatgagctcacctacaacctagagaagaagcgagatgagcgcagtgtgaagagcacagctgtgcgggtggtagactttggcagtgccacctttgaccatgagcaccatagcaccattgtctccactcgccattaccgagcaccagaagtcatccttgagttgggctggtcacagccttgtgatgtgtggagtataggctgcatcatctttgaatactatgtgggattcaccctcttccagacccatgacaacagagagcatctagccatgatggaaaggatcttgggtcctatcccttcccggatgatccgaaagacaagaaagcagaaatatttttaccggggtcgcctggattgggatgagaacacatcag

SEQ ID NO: 9569 - DNA, 449 bp, Homo sapiens
aaaccgtagttggcgcagaggtcagtcctagtcggagcttaggaggggcggagacgctcacatcgtctgacttgagtcgccactgattgtggcaacagctttgcctcatgagtcaaaaattggcaatttcttttgatttttagttgttgaatttgctgtttcaagcatttgtacatattagaagtctaaggagtagcaagtcagtgggaggactttttcacccctggcattagcagcttcgacctcattttccagatgcaccagctcctattaataagttagcaaggaaagtgtatgtcacgtgcaggaacagtgaggcagggacaggggttctgctccttctcacttcaccaccggcacacggcttgcccctgtctttgcccccaaaggtattttgtgtctagtgtcacattggagctattcttcactggtccttaaccttgggtttt

SEQ ID NO: 9570 - DNA, 101 bp, Homo sapiens; identical to SEQ ID NO: 186
  misc_feature (1)...(101): n = g, a, c or t

SEQ ID NO: 9571 - DNA, 84 bp, Homo sapiens; identical to SEQ ID NO: 188
  misc_feature (1)...(84): n = g, a, c or t

SEQ ID NO: 9572 - DNA, 307 bp, Homo sapiens
ctggggagagctaaaggactttgatgtgtaactgtgctgttgatgaagtcctcccagggaagcctgtgcagatgcagtcacctggaaagaacagagattaccctttcacctacctcagcaaaacaaactttcaagtcttgatagacttagcctagtaattttatagtgagagtttcaaactatatatcagtgtctatagcatcaaaaacttctgggggcgtgggggaagtagaataccaagtataatagttacattcactttcaaagagcatctatgaatttgccttttgtaacttactgtggcttt

SEQ ID NO: 9573 - DNA, 139 bp, Homo sapiens; identical to SEQ ID NO: 189
  misc_feature (1)...(139): n = g, a, c or t

SEQ ID NO: 9574 - DNA, 283 bp, Homo sapiens; identical to SEQ ID NO: 190
  misc_feature (1)...(283): n = g, a, c or t

SEQ ID NO: 9575 - DNA, 178 bp, Homo sapiens
aaaacagaaaaaatgcaaaactagggaagagaaccctagatattcactagggaaggtaccaaaatttccagaatcaaaaattccatcttctactggatgagtaaggtccaaattaaacctccaggttgacctcttgggcttcctgtctttctgcggcgccatcttgcgagtcggccgc

SEQ ID NO: 9576 - DNA, 261 bp, Homo sapiens
ccagcccgaagtcgacccctcagtcttgcttggatcatgccagccttcacccatctttgtgccctgaggtcttgggtgccaagggcagggcatcacagtcctctggctagctcccttctgagttggagctccctcaggagccccgcccaccctaagtgctggtctccacaatgcacttgaggaacattgtgtcgtccttcacgtaggcgtgcttgggtgactgcagtttgctgagggggaagaagagtgggcatccactgg

SEQ ID NO: 9577 - DNA, 224 bp, Homo sapiens
ccacctgaggacagcaccgctcacttcctcttgagggaacccttgctcttctccttgtctgctgaccgctgcttcttcactttctcctccctcttgttcttagtgtgcaggttctcatacacatcctccttgtgtctgcagccgggtgcaggggggcaagtacaggcagttggtgcaggtcaggagacagcacagggggacccggcactggcagtcccctctgg

SEQ ID NO: 9578 - DNA, 239 bp, Homo sapiens; identical to SEQ ID NO: 187

SEQ ID NO: 9579 - DNA, 307 bp, Homo sapiens
cctagggaaatccaccctcatcaacagcctcttcctcaccaacctctatgaggatcgccaggtgccagaggccagtggtaagaccctccccaccctcttgaggcagtagcccctgtccccaggttacaccctagtcttttccatctggggactcaggtagttgactgctttttttctgagactttcctcccctgggaaatgggtgcaggcaactgtgatattgacaaaggaaattaattctgcctcagagcctccccggatccctgacctctcccccatcccacagctcgcttgacacagaccctgg

SEQ ID NO: 9580 - DNA, 179 bp, Homo sapiens; identical to SEQ ID NO: 191
  misc_feature (1)...(179): n = g, a, c or t

SEQ ID NO: 9581 - DNA, 280 bp, Homo sapiens
ccagtgtggcggctcatgcctgtaatcccaacactttgggagaccaacatgagaggaacacgtgaggccaggagttcaagaccagctcagcaacacagcaagaccctgtctctacaaaaaaataaaattagccaggcatagtggcatacacttgtagtcccagctactcaggaggctgagataggagaattgcttgagcccagaaggtcaaggctgcaggtgagccatgatctcgccattgtactccagcctgggtaacagaatgaaagcctgtctcttt

SEQ ID NO: 9582 - DNA, 54 bp, Homo sapiens; identical to SEQ ID NO: 195
  misc_feature (1)...(54): n = g, a, c or t

SEQ ID NO: 9583 - DNA, 375 bp, Homo sapiens; identical to SEQ ID NO: 50

SEQ ID NO: 9584 - DNA, 130 bp, Homo sapiens; identical to SEQ ID NO: 197
  misc_feature (1)...(130): n = g, a, c or t

SEQ ID NO: 9585 - DNA, 464 bp, Homo sapiens
aaaagaaattggtaacatcactttctcagactcctctcctacatttctttaaccactgctcagcctcctttaccaagtcctttgactcttgtaaaatgttgatattcccagggttttctcaatggctttctttttattctacatcttctgcctcatggataagctcattgagatctatggctttgcctaataattataataaaagtattctaagcctgcattttcaaccagagttctatctccagctagaaatgcatataatccaattgcctactgaatgtatcccccatgaatgtttcattgaactcaacatgtgaagaaaactattggtctgtcccatgactgtttgcacttctctgttaacctgacaaattcctactccttccccatgagcattgtaaatccttgtgcacaatctgaaaacttatgagtgacctgagattttatctatcccctagcttttt

SEQ ID NO: 9586 - DNA, 90 bp, Homo sapiens; identical to SEQ ID NO: 192
  misc_feature (1)...(90): n = g, a, c or t

SEQ ID NO: 9587 - DNA, 585 bp, Homo sapiens; identical to SEQ ID NO: 183

SEQ ID NO: 9588 - DNA, 283 bp, Homo sapiens; identical to SEQ ID NO: 194

SEQ ID NO: 9589 - DNA, 191 bp, Homo sapiens; identical to SEQ ID NO: 198
  misc_feature (1)...(191): n = g, a, c or t

SEQ ID NO: 9590 - DNA, 238 bp, Homo sapiens
ctgacaaagtagtattttagaaaagttctaaagttataaaaatgttttctgcagtaaaaaaaaagttctttgggccgggcggggtggctcacacctgtaatcccagcaccttgggaggctgaggtgggaggatcatttgaggccaggagtttgagacctgcctgggcaacataatgaaacttcctttccagggagaaaaaaaaaaaaaaaaaagctctgagagcatcttattttgttt

SEQ ID NO: 9591 - DNA, 424 bp, Homo sapiens
  misc_feature (1)...(424): n = g, a, c or t
aaaaactccctatttatttttgttttttttttttcttcttttcctacgcaccattagccctaaaacgttgagagtaaacacttaccgaaagccgaccctggaccatgtgtctttagccatctcttggtgatgttgccaggaggatgggtcagtccaggagtggcagggcctaggtggcacctggaggtgaacacctaaccgcatgagtccttttccactgtcaggctacncggaaatactgttggtaggggggcgtntctgctgttggcagtgagaggtanaaactnggggttcttccttgctctcccctgacagacaaaaaagttcctcccccatggcttccaagctgtttccccctgtaagggaagctcgagagagagtctgctgttcagccatctgactgcttctaaatctgcttttcagg

SEQ ID NO: 9592 - DNA, 206 bp, Homo sapiens
  misc_feature (1)...(206): n = g, a, c or t
atttcatganacaagctggggaagtaacntttgcanatgcacaccgacctaaattaaatgaaggggtggttgagtttgcctcttatggtgacttaaagaatgctattgaaaaactttctggaaaggaaataaatgggagaaaaataaaattaattgaaggcagcaaaaggcacagtaggtcaagaagcaggtctcgatcccggacc

SEQ ID NO: 9593 - DNA, 290 bp, Homo sapiens
cctgtcacatgtggacctgtcacgtgtggactgtcacgtgtggacctgtcatgcatgcaccagtcacgtgtggacctgtcacgtgtgaacctgttgtgtggtcctgtcgtctgtgggcctgtcacgtgtggacgtgtcacgtgtggacccggctgaaggcaggatgcctcagccaatcctatgcctgggcagggcgggggatgcctctgcattttctgagccccatggccctgcagtgctgctgggtggctgtcacagacccaggccagcccctcctcccaggcaggcag

SEQ ID NO: 9594 - DNA, 282 bp, Homo sapiens; identical to SEQ ID NO: 199

SEQ ID NO: 9595 - DNA, 491 bp, Homo sapiens
aaagagaaacttaaatcctgttgtattctttcaacacaagcaatgatacttctcagagtctgctcaaaagctcagctctgtggactccgtgacaaaatgtacgcgtccactgccgaccctcttggtttctgaaaccaacctttcttcctgctctcctctttaagagcaaaccccaacatgtataaggtcacagcaagtggtagccagaaaaagctgtgggacccctcatttgagtcacatccatatggcatggagaaagaaaacctctctgccagaaggaactgaactctggaagtcctaaggaaggtcaccatgctcagcagataggaaagcattgccaagggctgtccctcaagagcttagttttcttagggagaccagaaagacatcagatcctgactgccctgttttgctcaagttctgaaatgagtggcatgatgaagagctggtggagctgagggaaagagtcaaccatgtggggtggggtagtg

SEQ ID NO: 9596 - DNA, 556 bp, Homo sapiens
  misc_feature (1)...(556): n = g, a, c or t
aaatcaactaaagactcatgagatttatttggttacagtgaataacctggacaaaatgttgagaagagttgttaaaacaagtttacattaaatatactaacaattacgtttggttacatatttgtaagtgatggttatttagaaaaactgcatanaaatccaaaccttaaatattctgcaaatcaaatcattagcttttctcttctctaataaagtagggtgactagttcttggattaatctaactataacattaatgtagcacttgattatcttatggaataattctctatctcatctaagcctcacaacaaccttgtaaagtattatccccattttatggaggaagaaacaggcttagaagtggaaaggtagattctctgctcgcacaaccgtattatgtggctaagctattgaacttgaacctagatttgggacttcatttcaaatatgaaattttttgattaaatctttttatcttgtatggaaaaaatatctcattagctgtcagatgttatttaccctgctaactgttaaaaatatttcattaaaaaaat

SEQ ID NO: 9597 - DNA, 261 bp, Homo sapiens
  misc_feature (1)...(261): n = g, a, c or t
aagctttttttttttttttttttttttttttttgngaaaatanctttatttcattgnggggagcgggccgatgtccancctcanaacttntggaactgcttnttggtgccggcagccttggtgaccttgagcacgttgaagcgcactgtcttgctcanaggccggcactcgcccactgtgacgatgtcaccgatctggacgtccctgaagcagggggacaggtgtacanacatgttnttgnggcgcttntcnaagcggttg

SEQ ID NO: 9598 - DNA, 622 bp, Homo sapiens
gcacacaaattgacttattagaaggcaatgtagcatcaggaaaagtagatgtgaatgaacagagtggtcagaggagaagttgtatttggttgaaccttgaaattaaaaatgatagaggaattattattgggaccgttgttaggaataatgacttttccactgcaagactgaagatatcagtgcccctctatattctgtgcaaaaggtgtctttgactcatccaaaaaattgaacagtttcctgtctcatggagatctatcacaaagtctttaaatattactacccatgaaattggccagggttaggacattcaaatgtctttatccacattcctgaaggataattgttatagattccctacctccataggaatgcttataatggattatctatacaatctccacattcccacattttgcattagagaatggaatcagtcaaaccctgttcccagagtttcccttagagttctcacctgttgtcttatatccatctaggaatccccatctctaatgtaagcttggagatccgggcccccgggggacaggtgactgaaggacaaaaactgatcctgctctgctcagtggctgagggtacaggaaatgtcacattctcctggtac

SEQ ID NO: 9599 - DNA, 523 bp, Homo sapiens
ctgtcatgaggtctcttctatagccatcaggtcttctcacagggatattcaccaccttgctctggataggcacatggccgttgtcagctctacagtaatatttgccggcatcactctctttcacagctgggatctccagctctgctgacagggaacgctgggttttctttcccatactggttcctgtggcctctctgtaccaggagaatgtgacatttcctgtacccccagccactgagcagagcaggatcagtttttgtccttcagtcacctgtcccccgggggcccggatctccaagcttacattagagatggggattcctagatggatataagacaacaggtgagaactctaagggaaactctgggaacagggtttgactgattccattctctaatgcaaaatgtgggaatgtggagattgtatagataatccattataagcattcctatggaggtagggaatctataacaattatccttcaggaatgtggataaagacatttgaatgtcctaaccctgg

SEQ ID NO: 9600 - DNA, 1908 bp, Homo sapiens
  misc_feature (1)...(1908): n = g, a, c or t
gacactcaacttcacagtgcctactggggccagaagcaatcatcttacctcaggagtcattgaggggctgctcagcacccttggnccagccaccgtggccttattattttgctacggcctcaaaagaaaaataggaagacgttcagccagggatccactcaggagccttcccagccctctaccccaagagttcacctacctcaactcacctaccccagggcagctacagcctatatatgaaaatgtgaatgttgtaagtggggatgaggtttattcactggcgtactataaccagccggagcaggaatcagtagcagcagaaaccctggggacacatatggaggacaagatgcagtcactgaacaggcagattcgctgacccttgtggcgccctcttctgtcttcgaaggagacagcatcgttctgaaatgccagggagaacagaactggaaaattcagaagatggcttaccataaggataacaaagagttatctgttttcaagaaaattctcagatttccttatccaaagtgcagttttaagtgacagtggtaactatttctgtagtaccaaaggacaactctttctctgggataaaacttcaaatatagtaaagattaaaagtccaaggaatccccatctctaatgtaagcttggagatccgggcccccgggggacaggtgactgaaggacaaaaactgatcctgctctgctcagtggctgggggtacaggaaatgtcacattctcctggtacagagaggccacaggaaccagtatgggaaagaaaacccagcgttccctgtcagcagagctggtagatcccagctgtgaaagagagtgatgccggcaaatattactgtagagctgacaacggccatgtgcctatccagagcaaggtggtgaatatccctgtgagaattccagtgtctcgccctgtcctcacccctcaggtctcctggggcccaggctgcagtgggggacctgctggagcttcactgtgaggcccctgagaggctctcccccaatcttgtaccaattttatcatgaggatgtcacccttgggaacagctcggcccctctggaggaggggcctccttcaacctctctttgactgcagaacattctggaaactactcctgtgaggccaacaacggcctgggggcccagtgcaggtggagggcagtgccaggtcctccatctcaggacctgatggctatagaaagagacctcatgacagctggagttctctggggacctgtttggtgtccttgcgttcactgggtgttgctttgctgttgtatgccttgttccacaagatatcaggagaaagttctgccactaatgaacccagaggggcttccaggccaaatcctcaagagttcacctattcaagcccaaccccagacatggaggagctgcagccacgtgtatgtcaatgtgggctctgtagatgtggatgtggtttattctcaggtctggagcatgcagcagccagaaagctcagcaaacatcaggacacttctggagaacaaggactcccaagtcatctactcttctgtgaagaaatcataacacttggaggaatcagaagggaagatcaacagcaaggatggggcatcattaagacttgctataaaaccttatgaaaatgcttgaggcttatcacctgccacagccagaacgtgcctcaggaggcacctcctgtcatttttgtcctgatgatgtttcttctccaatatcttcttttacctatcaatattcattgaactgctgctacatccagacactgtgcaaataaattatttctgctaccttctcttaagcaatcagtgtgtaaagatttgagggaagaatgaataagagatacaaggtctcaccttcatctactgtgaagtgatgagaacagg

SEQ ID NO: 9601 - DNA, 1329 bp, Homo sapiens
ccacgcgtccggtcctgaactgggctgaataaacatacctaaatatatgtttagaaatgctcctatgtatcagttttcccaggaacaactataatattatagaaatcttaaaattatttcctaataaaaaattataggatacaaaagaaaaaaaagaaatatgaagagggctggatgggcacaggaaaacaatcagatgagaacaacagatgaccgtgtctgcaggcagcacccagaactgatattcccctcaaacgtctaaatatattgttgagaaaattatctctaactgttctagtgggaatgtgggaatggaaaatatgcaacagccatggggccaggccctttgctgagcctgcaggttgggagtttgtgaatctattgaggcatcacaaatcttttctgatagcccctctgtgtctgtcagttccagtgtctcgccctgtcctcaccctcaggtctcctggggcccaggctgcagtgggggacctgctggagcttcactgtgaggccctgagaggctctcccccaatcttgtaccaattttatcatgaggatgtcacccttgggaacagctcggccccctctggaggaggggcctccttcaacctctctttgactgcagaacattctggaaactactcctgtgaggccaacaacggcctgggggcccagtgcagtgaggcagtgccagtctccatctcaggacctgatggctatagaagagacctcatgacagctggagttctctggggactgtttggtgtccttggtttcactggtgttgctttgctgttgtatgccttgttccacaagatatcaggagaaagttctgccactaatgaacccagaggggcttccaggccaaatcctcaagagttcacctattcaagcccaaccccagacatggaggagctgcagccagtgtatgtcaatgtgggctctgtagatgtggatgtggtttattctcaggtctggagcatgcagcagccagaaagctcagcaaacatcaggacacttctggagaacaaggactcccaagtcatctactcttctgtgaagaaatcataacacttggaggaatcagaagggaagatcaacagcaaggatggggcatcattaagacttgctataaaaccttatgaaaatgcttgaggcttatcacctgccacagccagaacgtgcctcaggaggcacctcctgtcatttttgtcctgatgatgtttcttctccaatatcttcttttacctatcaatattcattgaactgctgctacatccagacactgtgcaaataaattatttctgctaccttaaaaaaaaaaaaaaa

SEQ ID NO: 9602 - DNA, 1569 bp, Homo sapiens
  misc_feature (1)...(1569): n = g, a, c or t
tgctgccaaatgggacagcacacagcctgtgcacatactgacatgtgatgggtctccccacgggggctgcatttcacactcctccacctntctcaaactctaaggtcggcacttgacaccaaggtaacttctctcctgctcatgtgtcagtgtctacctgcccaagtaagtggctttcatacaccaagtcccaagttcttcccatcctaacagaagtaacccagcaagtcaaggccaggaggaccaggggtgcagacagaacacatactggaacacaggaggtgctcaattactatttgactgactganaaaaatgnntgantgattgaggaagaaaactgtgggtaatcaaactggcataaaatccagtgcactccctaggaaatccgggaggtattctggcttccctaagaaacaacggaagagaaggagcttggatgaggaaactgttcagcaagaggaagggcttctcacactttcatgtgcttgtggatcacctgaggatcctgtgaaaatacagatactgattcagtgggtctgcgtagagcctgagactgccattctaacatgttcccaggggatgctgatgctgctggccctgggactgcactgcatgcatgtgaagccctataggtctcagcagaggcccatggagagggaatgtgtggctctggctgcccagggcccaactcggttcacacggatcgtgctgctccctggccagcctttggccacagcaccaccagctgctgttgctgagagagcttcttctctgtgacatgttggctttcatcagccaccctgggaagcggaaagtagctgccactatctttgtttccccacctcaggcctcacactttcccatgaaaagggtgaatgtatataacctgagccctctccattcagagttgttctcccatctctgagcaatgggatgttctgttccgcttttatgatatccatcacatcttatcttgatctttgctcccagtggattgtacagtgatgacttttaagccccacggccctgaaataaaatccttccaagggcattggaagctcactccacctgaaccatggcttttcatgcttccaagtgtcagggccttgcccagatagacagggctgactctgctgccccaacctttcaaggaggaaaccagacacctgagacaggagcctgtatgcagcccagtgcagccttgcagaggacaaggctggaggcatttgtcatcactacagatatgcaactaaaatagacgtggagcaagagaaatgcattcccaccgaggccgcttttttaggcctagttgaaagtcaagaaggacagcagcaagcataggctcaggattaaagaaaaaatctgctcacagtctgttctggaggtcacatcaccaacaaagctcacgccctatgcagttctgagaaggtggaggcaccaggctcaaaagaggaaatttagaatttctcattgggagagtaaggtacccccatcccagaatgataactgcacagtggcagaacaaactccaccctaatgtgggtggaccccatccagtctgttgaagg

SEQ ID NO: 9603 - DNA, 800 bp, Homo sapiens
ctgataacgttcacagccccatcctcagcacgtggattcgagtcaccgtgagaattccggtatctcaccctgtcctcaccttcagggctcccagggcccacactgtggtgggggacctgctggagcttcactgtgagtccctgagaggctctcccccgatcctgtaccgattttatcatgaggatgtcaccctggggaacagctcagccccctctggaggaggagcctccttcaacctctctctgactgcagaacattctggaaactactcctgtgatgcagacaatggcctgggggcccagcacagtcatggagtgagtctcagggtcacagttccggtgtctcgccccgtcctcaccctcagggctcccggggcccaggctgtggtgggggacccgctggagcttcactgtgagtccctgagaggctccttcccgatcctgtactggttttatcacgaggatgacaccttggggaacatctcggcccactctggaggaggggcatccttcaacctctctctgactacagaacattctggaaactactcatgtgaggctgacaatggcctgggggcccagcacagtaaagtggtgacactcaatgttacaggaacttccaggaacagaacaggccttaccrctgcgggaatcacggggctggtgstcarcatcytcgtccttgywgctgctgctgctctgctgcattacgccagggcccgaaggaaaccaggaggactttctgccactggaacatctagtcacagtcctagtgagtgtcaggagccttcctcgtccagg

SEQ ID NO: 9604 - DNA, 2474 bp, Homo sapiens
ctcaatcagctttatgcagagaagaagcttactgagctcactgctggtgctggtgtaggcaagtgctgctttggcaatctgggctgacctggcttgtctcctcagaactccttctccaatcctggagcaggcttccatgctgctgtgggcgtccttgctggcctttgctccagtctgtggacaatctgcagctgcacacaaacctgtgatttccgtccatcctccatggaccacattcttcaaaggagagagagtgactctgacttgcaatggatttcagttctatgcaacagagaaaacaacatggtatcatcggcactactggggagaaaagttgaccctgaccccaggaaacaccctcgaggttcgggaatctggactgtacagatgccaggcccggggctccccacgaagtaaccctgtgcgcttgctcttttcttcagactccttaatcctgcaggcaccatattctgtgtttgaaggtgacacattggttctgagatgccacagaagaaggaaagagaaattgactgctgtgaaatatacttggaatggaaacattctttccatttctaataaaagctgggatcttcttatcccacaagcaagttcaaataacaatggcaattatcgatgcattggatatggagacgagaatgatgtatttagatcaaatttcaaaataattaaaattcaagaactatttccacatccagagctgaaagctacagactctcagcctacagaggggaattctgtaaacctgagctgtgaaacacagcttcctccagagcggtcagacaccccacttcacttcaacttcttcagagatggcgaggtcatcctgtcagactggagcacgtacccggaactccagctcccaaccgtctggagagaaaactcaggatcctattggtgtggtgctgaaacagtgaggggtaacatccacaagcacagtccctcgctacagatccatgtgcagcggatccctgtgtctggggtgctcctggagacccagccctcagggggccaggctgttgaaggggagatgctggtccttgtctgctccgtggctgaaggcacaggggataccacattctcctggcaccgagaggacatgcaggagagtctggggaggaaaactcagcgttccctgagagcagagctggagctccctgccatcagacagagccatgcagggggatactactgtacagcagacaacagctacggccctgtccagagcatggtgctgaatgtcactgtgagagagaccccaggcaacagagatggccttgtcgccgcgggagccactggagggctgctcagtgctcttctcctggctgtggccctgctgtttcactgctggcgtcggaggaagtcaggagttggtttcttgggagacgaaaccaggctccctcccgctccaggcccaggagagtcctcccattccatctgccctgcccaggtggagcttcagtcgttgtatgttgatgtacaccccaaaaagggagatttggtatactctgagatccagactactcagctgggagaagaagaggaagctaatacctccaggacacttctagaggataaggatgtctcagttgtctactctgaggtaaagacacaacacccagataactcagctggaaagatcagctctaaggatgaagaaagttaagagaatgaaaagttacgagaacgtcctactcatgtgatttctcccttgtccaaagtcccaggcccagtgcagtccttgcggcccctggaatgatcaactcattccagctttctaattcttctcatgcatatgcattcactcccaggaatactcattcgtctactctgatgttgggatggaatggcctctgaaagacttcactaaaatgaccaggatccacagttaagagaagaccctgtagtatttgctgtgggcctgacctaatgtattccctagggtctgctttagagaagggggataaagagagagaaggactgttatgaaaaacagaagcacaaattttggtgaattgggatttgcagagatgaaaaagactgggtgacctggatctctgcttaatacatctacaaccattgtctcactggagactcacttgcatcagtttgtttaactgtgagtggctgcacaggcactgtgcaaacaatgaaaagccccttcacttctgcctgcacagcttacactgtcaggattcagttgcagattaaagaacccatctggaatggtttacagagagaggaatttaaaagaggacatcagaagagctggagatgcaagctctaggctgcgcttccaaaagcaaatgataattatgttaatgtcattagtgacaaagatttgcaacattagagaaaagagacacaaatataaaattaaaaacttaagtaccaactctccaaaactaaatttgaacttaaaatattagtataaactcataataaactctgccttt

SEQ ID NO: 9605 - DNA, 2797 bp, Homo sapiens
gtgcagtgtcctgactgtaagatcaagtccaaacctgttttggaattgaggaaacttctcttttgatctcagcccttggtggtccaggtcttcatgctgctgtgggtgatattactggtcctggctcctgtcagtggacagtttgcaaggacacccaggcccattattttcctccagcctccatggaccacagtcttccaaggagagagagtgaccctcacttgcaagggatttcgcttctactcaccacagaaaacaaaatggtaccatcggtaccttgggaaagaaatactaagagaaaccccagacaatatccttgaggttcaggaatctggagagtacagatgccaggcccagggctcccctctcagtagccctgtgcacttggatttttcttcagcttcgctgatcctgcaagctccactttctgtgtttgaaggagactctgtggttctgaggtgccgggcaaaggcggaagtaacactgaataatactatttacaagaatgataatgtcctggcattccttaataaaagaactgacttccatattcctcatgcatgtctcaaggacaatggtgcatatcgctgtactggatataaggaaagttgttgccctgtttcttccaatacagtcaaaatccaagtccaagagccatttacacgtccagtgctgagagccagctccttccagcccatcagcgggaacccagtgaccctgacctgtgagacccagctctctctagagaggtcagatgtcccgctccggttccgcttcttcagagatgaccagaccctgggattaggctggagtctctccccgaatttccagattactgccatgtggagtaaagattcagggttctactggtgtaaggcagcaacaatgcctcacagcgtcatatctgacagcccgagatcctggatacaggtgcagatccctgcatctcatcctgtcctcactctcagccctgaaaaggctctgaattttgagggaaccaaggtgacacttcactgtgaaacccaggaagattctctgcgcactttgtacaggttttatcatgagggtgtccccctgaggcacaagtcagtccgctgtgaaaggggagcatccatcagcttctcactgactacagagaattcagggaactactactgcacagctgacaatggccttggcgccaagcccagtaaggctgtgagcctctcagtcactgttcccgtgtctcatcctgtcctcaacctcagctctcctgaggacctgatttttgagggagccaaggtgacacttcactgtgaagcccagagaggttcactccccatcctgtaccagtttcatcatgaggatgctgccctggagcgtaggtcggccaactctgcaggaggagtggccatcagcttctctctgactgcagagcattcagggaactactactgcacagctgacaatggctttggcccccagcgcagtaaggcggtgagcctctccatcactgtccctgtgtctcatcctgtcctcaccctcagctctgctgaggccctgacttttgaaggagccactgtgacacttcactgtgaagtccagagaggttccccacaaatcctataccagttttatcatgaggacatgcccctgtggagcagctcaacaccctctgtgggaagagtgtccttcagcttctctctgactgaaggacattcagggaattactactgcacagctgacaatggctttggtccccagcgcagtgaagtggtgagcctttttgtcactgttccagtgtctcgccccatcctcaccctcagggttcccagggcccaggctgtggtgggggacctgctggagcttcactgtgaggccccgagaggctctcccccaatcctgtactggttttatcatgaggatgtcaccctggggagcagctcagccccctctggaggagaagcttctttcaacctctctctgactgcagaacattctggaaactactcatgtgaggccaacaatggcctagtggcccagcacagtgacacaatatcactcagtgttatagttccagtatctcgtcccatcctcaccttcagggctcccagggcccaggctgtggtgggggacctgctggagcttcactgtgaggccctgagaggctcctccccaatcctgtactggttttatcatgaagatgtcaccctgggtaagatctcagccccctctggaggaggggcctccttcaacctctctctgactacagaacattctggaatctactcctgtgaggcagacaatggtctggaggcccagcgcagtgagatggtgacactgaaagttgcaggtgagtgggccctgcccaccagcagcacatctgagaactgactgtgcctgttctccctgcagctgaaaatggagccacagagctcctcagggctgtttgcttgtgtggcatcccagcacacttcctgcctgcagaacctccctgtgaaagtctcggatcctttgtggtatggttccaggaatctgatgtttcccagcagtcttcttgaagatgatcaaagcacctcactaaaaatgcaaataagacttttttagaacataaactatattctgaactgaaattattacatgaaaatgaaaccaaagaattctgagcatatgtttctctgccgtagaaaggattaagctgtttcttgtccggattcttctctcattgacttctaagaagcctctactcttgagtctctttcattactggggatgtaaatgttccttacatttccacattaaaaatcctatgttaacg

SEQ ID NO: 9606 - DNA, 4422 bp, Homo sapiens
gtgcagtgtcctgactgtaagatcaagtccaaacctgttttggaattgaggaaacttctcttttgatctcagcccttggtggtccaggtcttcatgctgctgtgggtgatattactggtcctggctcctgtcagtggacagtttgcaaggacacccaggcccattattttcctccagcctccatggaccacagtcttccaaggagagagagtgaccctcacttgcaagggatttcgcttctactcaccacagaaaacaaaatggtaccatcggtaccttgggaaagaaatactaagagaaaccccagacaatatccttgaggttcaggaatctggagagtacagatgccaggcccagggctcccctctcagtagccctgtgcacttggatttttcttcagcttcgctgatcctgcaagctccactttctgtgtttgaaggagactctgtggttctgaggtgccgggcaaaggcggaagtaacactgaataatactatttacaagaatgataatgtcctggcattccttaataaaagaactgacttccatattcctcatgcatgtctcaaggacaatggtgcatatcgctgtactggatataaggaaagttgttgccctgtttcttccaatacagtcaaaatccaagtccaagagccatttacacgtccagtgctgagagccagctccttccagcccatcagcgggaacccagtgaccctgacctgtgagacccagctctctctagagaggtcagatgtcccgctccggttccgcttcttcagagatgaccagaccctgggattaggctggagtctctccccgaatttccagattactgccatgtggagtaaagattcagggttctactggtgtaaggcagcaacaatgcctcacagcgtcatatctgacagcccgagatcctggatacaggtgcagatccctgcatctcatcctgtcctcactctcagccctgaaaaggctctgaattttgagggaaccaaggtgacacttcactgtgaaacccaggaagattctctgcgcactttgtacaggttttatcatgagggtgtccccctgaggcacaagtcagtccgctgtgaaaggggagcatccatcagcttctcactgactacagagaattcagggaactactactgcacagctgacaatggccttggcgccaagcccagtaaggctgtgagcctctcagtcactgttcccgtgtctcatcctgtcctcaacctcagctctcctgaggacctgatttttgagggagccaaggtgacacttcactgtgaagcccagagaggttcactccccatcctgtaccagtttcatcatgaggatgctgccctggagcgtaggtcggccaactctgcaggaggagtggccatcagcttctctctgactgcagagcattcagggaactactactgcacagctgacaatggctttggcccccagcgcagtaaggcggtgagcctctccatcactgtccctgtgtctcatcctgtcctcaccctcagctctgctgaggccctgacttttgaaggagccactgtgacacttcactgtgaagtccagagaggttccccacaaatcctataccagttttatcatgaggacatgcccctgtggagcagctcaacaccctctgtgggaagagtgtccttcagcttctctctgactgaaggacattcagggaattactactgcacagctgacaatggctttggtccccagcgcagtgaagtggtgagcctttttgtcactggtaagtgctgggttcttgccagtcacccacccctggctgagttctctctcacccattcctttaaaaatctgtttgcactgtccagtttcctcccctaatcaacttaatccccttcttggcttcctcctcaactaactagctggggttttccgtactcataagtcctggctcagccagacccctaaaacagctcagtagattccccagcttttaccaaatgaatttatttattgtattttctcctcattccttgtatgttccaacagtacgccaatttttcttgatgcacggagcgtgtcctacttctctactgacatttacatattaacttagctacaagcacagtcttatagataaatattggtcaagaccttaaattctccaaaggatttccaatcttatggtagatttggagaaagctgctggtgaacaaagggggaaatggctccctaggaaccaactcctcaaacttctggagtttttatgatcccttgttttctaacctgctaaaatcagtatcattttattgtattattttaaaaaaactattgttgaagtatgacatacattcaagaaacgtgtgcaaattgtatgtgtacgatttggtgtctttttaggagctaagttgcttctgtttttacttgaatctttgtttatagaaactgggggaaagtttactttcttttcagagaagccaaatggtatgatagaaaaatcttgagcctgatgtgtcagacatgcccctagcataacttgttgagtaaagaggttatttttaaaatgtgaatgttctgagactactccaaagtcagagccaaatctactaggaagcttctagacttcactcattctgcatcccattactatctttttatccatgttttactttcttctcatattcagcagcatcttaagcctctttattttctgtttcttgactgtcacccttaatgccagtagaatgtaagcttcatgagaacagaactgcatccatcttggtcttcacaacatccctgtgcctactcagtgtttggcacacagtaggtcctcagtcaacatttgtaatttagtggacagatgatatgacaagatgataagaggggatttaaaaaaatcatctagcaaagcccaagaggaaaaaaaacaaagctattttagaaatgaaataccaatttgaagcagtaagaatagattggatatctttgaaaaccattaattgaatgaagaaccaatttgagaaaacaatacagaatgcaaagtagaaagatacagaaataaaggcaaaagttataatatggaaatcagacaatggatttgtctgtatccagttatgtggataattaaaatggagaccctcagaaaattgaaccgaagagtaaaatgaaactcaaaaatgtagtagaaattgttgggaagtaaagaaaacttgaatatgtagatcagaacatatatgttgatgacgttattgactttgaggttaaaaatatatatatgtgcctatgattatggggaaaaaagcagtcgtctcagaaagaaaaacatcaagttagtcttagactttgcagtgcactcagtaccaaagagagaggaggccagacttggacctgcgagggaagaataataaccgaaaattttatatcaattcaaaaagacattgtcaaaaatacagggattcaggaaactgagaatgcactaagccttctggaaaaaacacctaatgacaaaatctagcccaacaagatgtaaatgaatataaaggactcataatgaggaaaccgcattatgactggctctcaaccctggccgcatattagactcgtcaaagacctttgtaaaaggtcacacattgactcgtcaaagcccctctccagactaattcaattcagaatctcacagatggggccacagaatcagtattttttgacacaacctcaagtgagaatattgtgtagacaagattggaaaccactgatttagatatagaaacaaaggctaatcaactgtgagaattatggtcacagaatagaaagtaactattatgaacactgaaaatgtaaaaaaaatgtaacaaagaaaaatagttagaggaaggagaggaagtaaaggaacaatcattttctcatgattattattatttcagagtaaattgtgagttatttcacaattcaaaaagaatggactgttttaaaaaattagtaatagatttcaaaatgtccattttgtaaatcgtttctgaatactttgtcaacagttactcatcattaatggcttatacttcactaaaattccatggaaaaccaactagtagcctgtagagtcacataggagagaacaagtgaattctttgggtggcgcaagcatagatgttaggactgacaaaaaaaaataataaaaataaacctgtgcattgatatgatcacaaatgatcagggaaagaggaaacagaaactctcatacgccattattacaagtgtaaattggttcaaccttttcgtcttaattgacacattgtaattgtatatatttatggaagcacagtttgatattttgatatacatacatggtatataacgatcaaattaggatatttaatgtacccatcatctcatgcatttatcatttctttggaataaaaacattcaaaagcc

SEQ ID NO: 9607 - DNA, 5321 bp, Homo sapiens
gtgcagtgtcctgactgtaagatcaagtccaaacctgttttggaattgaggaaacttctcttttgatctcagcccttggtggtccaggtcttcatgctgctgtgggtgatattactggtcctggctcctgtcagtggacagtttgcaaggacacccaggcccattattttcctccagcctccatggaccacagtcttccaaggagagagagtgaccctcacttgcaagggatttcgcttctactcaccacagaaaacaaaatggtaccatcggtaccttgggaaagaaatactaagagaaaccccagacaatatccttgaggttcaggaatctggagagtacagatgccaggcccagggctcccctctcagtagccctgtgcacttggatttttcttcagcttcgctgatcctgcaagctccactttctgtgtttgaaggagactctgtggttctgaggtgccgggcaaaggcggaagtaacactgaataatactatttacaagaatgataatgtcctggcattccttaataaaagaactgacttccatattcctcatgcatgtctcaaggacaatggtgcatatcgctgtactggatataaggaaagttgttgccctgtttcttccaatacagtcaaaatccaagtccaagagccatttacacgtccagtgctgagagccagctccttccagcccatcagcgggaacccagtgaccctgacctgtgagacccagctctctctagagaggtcagatgtcccgctccggttccgcttcttcagagatgaccagaccctgggattaggctggagtctctccccgaatttccagattactgccatgtggagtaaagattcagggttctactggtgtaaggcagcaacaatgcctcacagcgtcatatctgacagcccgagatcctggatacaggtgcagatccctgcatctcatcctgtcctcactctcagccctgaaaaggctctgaattttgagggaaccaaggtgacacttcactgtgaaacccaggaagattctctgcgcactttgtacaggttttatcatgagggtgtccccctgaggcacaagtcagtccgctgtgaaaggggagcatccatcagcttctcactgactacagagaattcagggaactactactgcacagctgacaatggccttggcgccaagcccagtaaggctgtgagcctctcagtcactgttcccgtgtctcatcctgtcctcaacctcagctctcctgaggacctgatttttgagggagccaaggtgacacttcactgtgaagcccagagaggttcactccccatcctgtaccagtttcatcatgaggatgctgccctggagcgtaggtcggccaactctgcaggaggagtggccatcagcttctctctgactgcagagcattcagggaactactactgcacagctgacaatggctttggcccccagcgcagtaaggcggtgagcctctccatcactgtccctgtgtctcatcctgtcctcaccctcagctctgctgaggccctgacttttgaaggagccactgtgacacttcactgtgaagtccagagaggttccccacaaatcctataccagttttatcatgaggacatgcccctgtggagcagctcaacaccctctgtgggaagagtgtccttcagcttctctctgactgaaggacattcagggaattactactgcacagctgacaatggctttggtccccagcgcagtgaagtggtgagcctttttgtcactgttccagtgtctcgccccatcctcaccctcagggttcccagggcccaggctgtggtgggggacctgctggagcttcactgtgaggccccgagaggctctcccccaatcctgtactggttttatcatgaggatgtcaccctggggagcagctcagccccctctggaggagaagcttctttcaacctctctctgactgcagaacattctggaaactactcatgtgaggccaacaatggcctagtggcccagcacagtgacacaatatcactcagtgttatagttccagtatctcgtcccatcctcaccttcagggctcccagggcccaggctgtggtgggggacctgctggagcttcactgtgaggccctgagaggctcctccccaatcctgtactggttttatcatgaagatgtcaccctgggtaagatctcagccccctctggaggaggggcctccttcaacctctctctgactacagaacattctggaatctactcctgtgaggcagacaatggtctggaggcccagcgcagtgagatggtgacactgaaagttgcagttccggtgtctcgcccggtcctcaccctcagggctcccgggacccatgctgcggtgggggacctgctggagcttcactgtgaggccctgagaggctctcccctgatcctgtaccggttttttcatgaggatgtcaccctaggaaataggtcgtccccctctggaggagcgtccttaaacctctctctgactgcagagcactctggaaactactcctgtgaggccgacaatggcctcggggcccagcgcagtgagacagtgacactttatatcacagggctgaccgcgaacagaagtggcccttttgccacaggagtcgccgggggcctgctcagcatagcaggccttgctgcgggggcactgctgctctactgctggctctcgagaaaagcagggagaaagcctgcctctgaccccgccaggagcccttcagactcggactcccaagagcccacctatcacaatgtaccagcctgggaagagctgcaaccagtgtacactaatgcaaatcctagaggagaaaatgtggtttactcagaagtacggatcatccaagagaaaaagaaacatgcagtggcctctgaccccaggcatctcaggaacaagggttcccctatcatctactctgaagttaaggtggcgtcaaccccggtttccggatccctgttcttggcttcctcagctcctcacagatgagtccacacgtctctccaactgctgtttcagcctctgcaccccaaagttccccttgggggagaagcagcattgaagtgggaagatttaggctgccccagaccatatctactggcctttgtttcacatgtcctcattctcagtctgaccagaatgcagggccctgctggactgtcacctgtttcccagttaaagccctgactggcaggttttttaatccagtggcaaggtgctcccactccagggcccagcacatctcctggattccttagtgggcttcagctgtggttgctgttctgagtactgctctcatcacacccccacagagggggtcttaccacacaaagggagagtgggccttcaggagatgccgggctggcctaacagctcaggtgctcctaaactccgacacagagttcctgctttgggtggatgcatttctcaattgtcatcagcctggtggggctactgcagtgtgctgccaaatgggacagcacacagcctgtgcacatgggacatgtgatgggtctccccacgggggctgcatttcacactcctccacctgtctcaaactctaaggtcggcacttgacaccaaggtaacttctctcctgctcatgtgtcagtgtctacctgcccaagtaagtggctttcatacaccaagtcccgaagttcttcccatcctaacagaagtaacccagcaagtcaaggccaggaggaccaggggtgcagacagaacacatactggaacacaggaggtgctcaattactatttgactgactgactgaatgaatgaatgaatgaggaagaaaactgtgggtaatcaaactggcataaaatccagtgcactccctaggaaatccgggaggtattctggcttcctaagaaacaacggaagagaaggagcttggatgaagaaactgttcagcaagaagaagggcttcttcacacttttatgtgcttgtggatcacctgaggatctgtgaaaatacagatactgattcagtgggtctgtgtagagcctgagactgccattctaacatgttcccaggggatgctgatgctgctggccctgggactgcactgcatgcatgtgaagccctataggtctcagcagaggcccatggagagggaatgtgtggctctggctgcccagggcccaactcggttcacacggatcgtgctgctccctggccagcctttggccacagcaccaccagctgctgttgctgagagagcttcttctctgtgacatgttggctttcatcagccaccctgggaagcggaaagtagctgccactatctttgtttccccacctcaggcctcacactttcccatgaaaagggtgaatgtatataacctgagccctctccattcagagttgttctcccatctctgagcaatgggatgttctgttccgcttttatgatatccatcacatcttatcttgatctttgctcccagtggattgtacagtgatgacttttaagccccacggccctgaaataaaatccttccaagggcattggaagctcactccacctgaaccatggcttttcatgcttccaagtgtcagggccttgcccagatagacagggctgactctgctgccccaacctttcaaggaggaaaccagacacctgagacaggagcctgtatgcagcccagtgcagccttgcagaggacaaggctggaggcatttgtcatcactacagatatgcaactaaaatagacgtggagcaagagaaatgcattcccaccgaggccgcttttttaggcctagttgaaagtcaagaaggacagcagcaagcataggctcaggattaaagaaaaaaatctgctcacagtctgttctggaggtcacatcaccaacaaagctcacgccctatgcagttctgagaaggtggaggcaccaggctcaaaagaggaaatttagaatttctcattgggagagtaaggtacccccatcccagaatgataactgcacagtggcagaacaaactccaccctaatgtgggtggaccccatccagtctgttgaaggcctgaatgtaacaaaagggcttattcttcctcaagtaagggggaactcctgctttgggctgggacataagtttttctgctttcagacgcaaactgaaaaatggctcttcttgggtcttgagcttgctggcatatggactgaaagaaactatgctattggatctcctggatctccagcttgctgactgcagatcttgagatatgtcagcctctacagtcacaagagctaattcattctaataaaccaatctttc

SEQ ID NO: 9608 - DNA, 2970 bp, Homo sapiens
agtgaaggggtttcccatatgaaaaatacagaaagaattatttgaatactagcaaatacacaacttgatatttctagagaacccaggcacagtcttggagacattactcctgagagactgcagctgatggaagatgagccccaacttctaaaaatgtatcactaccgggattgagatacaaacagcatttaggaaggtctcatctgagtagcagcttcctgccctccttcttggagataagtcgggcttttggtgagacagactttcccaaccctctgcccggccggtgcccatgcttctgtggctgctgctgctgatcctgactcctggaagagaacaatcaggggtggccccaaaagctgtacttctcctcaatcctccatggtccacagccttcaaaggagaaaaagtggctctcatatgcagcagcatatcacattccctagcccagggagacacatattggtatcacgatgagaagttgttgaaaataaaacatgacaagatccaaattacagagcctggaaattaccaatgtaagacccgaggatcctccctcagtgatgccgtgcatgtggaattttcacctgactggctgatcctgcaggctttacatcctgtctttgaaggagacaatgtcattctgagatgtcaggggaaagacaacaaaaacactcatcaaaaggtttactacaaggatggaaaacagcttcctaatagttataatttagagaagatcacagtgaattcagtctccagggataatagcaaatatcattgtactgcttataggaagttttacatacttgacattgaagtaacttcaaaacccctaaatatccaagttcaagagctgtttctacatcctgtgctgagagccagctcttccacgcccatagaggggagtcccatgaccctgacctgtgagacccagctctctccacagaggccagatgtccagctgcaattctccctcttcagagatagccagaccctcggattgggctggagcaggtcccccagactccagatccctgccatgtggactgaagactcagggtcttactggtgtgaggtggagacagtgactcacagcatcaaaaaaaggagcctgagatctcagatacgtgtacagagagtccctgtgtctaatgtgaatctagagatccggcccaccggagggcagctgattgaaggagaaaatatggtccttatttgctcagtagcccagggttcagggactgtcacattctcctggcacaaagaaggaagagtaagaagcctgggtagaaagacccagcgttccctgttggcagagctgcatgttctcaccgtgaaggagagtgatgcagggagatactactgtgcagctgataacgttcacagccccatcctcagcacgtggattcgagtcaccgtgagaattccggtatctcaccctgtcctcaccttcagggctcccagggcccacactgtggtgggggacctgctggagcttcactgtgagtccctgagaggctctcccccgatcctgtaccgattttatcatgaggatgtcaccctggggaacagctcagccccctctggaggaggagcctccttcaacctctctctgactgcagaacattctggaaactactcctgtgatgcagacaatggcctgggggcccagcacagtcatggagtgagtctcagggtcacagttccggtgtctcgccccgtcctcaccctcagggctcccggggcccaggctgtggtgggggacctgctggagcttcactgtgagtccctgagaggctccttcccgatcctgtactggttttatcacgaggatgacaccttggggaacatctcggcccactctggaggaggggcatccttcaacctctctctgactacagaacattctggaaactactcatgtgaggctgacaatggcctgggggcccagcacagtaaagtggtgacactcaatgttacaggaacttccaggaacagaacaggccttaccgctgcgggaatcacggggctggtgctcagcatcctcgtccttgctgctgctgctgctctgctgcattacgccagggcccgaaggaaaccaggaggactttctgccactggaacatctagtcacagtcctagtgagtgtcaggagccttcctcgtccaggccttccaggatagaccctcaagagcccactcactctaaaccactagccccaatggagctggagccaatgtacagcaatgtaaatcctggagatagcaacccgatttattcccagatctggagcatccagcatacaaaagaaaactcagctaattgtccaatgatgcatcaagagcatgaggaacttacagtcctctattcagaactgaagaagacacacccagacgactctgcaggggaggctagcagcagaggcagggcccatgaagaagatgatgaagaaaactatgagaatgtaccacgtgtattactggcctcagaccactagccccttacccagagtggcccacaggaaacagcctgcaccatttttttttctgttctctccaaccacacatcatccatctctccagactctgcctcctacgaggctgggctgcagggtatgtgaggctgagcaaaaggtctgcaaatctcccctgtgcctgatctgtgtgttccccaggaagagagcaggcagcctctgagcaagcactgtgttattttcacagtggagacacgtggcaaggcaggagggccctcagctcctagggctgtcgaatagaggaggagagagaaatggtctagccagggttacaagggcacaatcatgaccatttgatccaagtgtgatcgaaagctgttaatgtgctctctgtataaacaatttgctccaaatattttgtttcccttttttgtgtggctggtagtggcattgctgatgttttggtgtatatgctgtatccttgctaccatattggg

SEQ ID NO: 9609 - DNA, 2580 bp, Homo sapiens
tggtgaccaagagtacatctcttttcaaatagctggattaggtcctcatgctgctgtggtcattgctggtcatctttgatgcagtcactgaacaggcagattcgctgacccttgtggcgccctcttctgtcttcgaaggagacagcatcgttctgaaatgccagggagaacagaactggaaaattcagaagatggcttaccataaggataacaaagagttatctgttttcaaaaaattctcagatttccttatccaaagtgcagttttaagtgacagtggtaactatttctgtagtaccaaaggacaactctttctctgggataaaacttcaaatatagtaaagataaaagtccaagagctctttcaacgtcctgtgctgactgccagctccttccagcccatcgaagggggtccagtgagcctgaaatgtgagacccggctctctccacagaggttggatgttcaactccagttctgcttcttcagagaaaaccaggtcctggggtcaggctggagcagctctccggagctccagatttctgccgtgtggagtgaagacacagggtcttactggtgcaaggcagaaacggtgactcacaggatcagaaaacagagcctccaatcccagattcacgtgcagagaatccccatctctaatgtaagcttggagatccgggcccccgggggacaggtgactgaaggacaaaaactgatcctgctctgctcagtggctgggggtacaggaaatgtcacattctcctggtacagagaggccacaggaaccagtatgggaaagaaaacccagcgttccctgtcagcagagctggagatcccagctgtgaaagagagtgatgccggcaaatattactgtagagctgacaacggccatgtgcctatccagagcaaggtggtgaatatccctgtgagaattccagtgtctcgccctgtcctcaccctcaggtctcctggggcccaggctgcagtgggggacctgctggagcttcactgtgaggccctgagaggctctcccccaatcttgtaccaattttatcatgaggatgtcacccttgggaacagctcggccccctctggaggaggggcctccttcaacctctctttgactgcagaacattctggaaactactcctgtgaggccaacaacggcctgggggcccagtgcagtgaggcagtgccagtctccatctcaggacctgatggctatagaagagacctcatgacagctggagttctctggggactgtttggtgtccttggtttcactggtgttgctttgctgttgtatgccttgttccacaagatatcaggagaaagttctgccactaatgaacccagaggggcttccaggccaaatcctcaagagttcacctattcaagcccaaccccagacatggaggagctgcagccagtgtatgtcaatgtgggctctgtagatgtggatgtggtttattctcaggtctggagcatgcagcagccagaaagctcagcaaacatcaggacacttctggagaacaaggactcccaagtcatctactcttctgtgaagaaatcataacacttggaggaatcagaagggaagatcaacagcaaggatggggcatcattaagacttgctataaaaccttatgaaaatgcttgaggcttatcacctgccacagccagaacgtgcctcaggaggcacctcctgtcatttttgtcctgatgatgtttcttctccaatatcttcttttacctatcaatattcattgaactgctgctacatccagacactgtgcaaataaattatttctgctaccttctcttaagcaatcagtgtgtaaagatttgagggaagaatgaataagagatacaaggtctcaccttcatctactgtgaagtgatgagaacaggacttgatagtggtgtattaacttatttatgtgctgctggatacagtttgctaatattttgttgagaatttttgcaaatatgttcattgggaatattggcctgaaattttcttttccactgtgtctctgccagaatgtttgtatcaggctgatgctggcttcatagaatgagttaggcaggagcccttcctccttgattttttggcatagtttcagcaggattggtaccagttattctttctgcatcttgtagaattcagctatgaatccatctggtctagggcttttgtgttggttggtaagttttttattactaattcaacttcagcgcttgatattggtctaggaggggtttctgtctcttcctggttcaatcttgggagattgtgtgtttccaggaatttagccgtttcctccagattttcttctttatgtgcatcgacttgagtgtaaacataacttatatgcactgggaaaccaaaaaatctgtgtgacttgctttattgcagcatttgttttattttggtagtctggaactgaacctgcaatatcaccaaagtatgcatatagttgcaaaaatgtgatttttgacatagtaaatatgagtatttgcaataaactatgatattacttttgtaagtatatagaataaaatgtaaataatctataaaa

SEQ ID NO: 9610 - DNA, 2303 bp, Homo sapiens
gaggcatctctaggtaccatccctgacctggtcctcatgctgccgaggctgttgctgttgatctgtgctccactctgtgaacctgccgagctgtttttgatagccagcccctcccatcccacagaggggagcccagtgaccctgacgtgtaagatgccctttctacagagttcagatgcccagttccagttctgctttttcagagacacccgggccttgggcccaggctggagcagctcccccaagctccagatcgctgccatgtggaaagaagacacagggtcatactggtgcgaggcacagacaatggcgtccaaagtcttgaggagcaggagatcccagataaatgtgcacagggtccctgtcgctgatgtgagcttggagactcagcccccaggaggacaggtgatggagggagacaggctggtcctcatctgctcagttgctatgggcacaggagacatcaccttcctttggtacaaaggggctgtaggtttaaaccttcagtcaaagacccagcgttcactgacagcagagtatgagattccttcagtgagggagagtgatgctgagcaatattactgtgtagctgaaaatggctatggtcccagccccagtgggctggtgagcatcactgtcagaatcccggtgtctcgcccaatcctcatgctcagggctcccagggcccaggctgcagtggaggatgtgctggagcttcactgtgaggccctgagaggctctcctccaatcctgtactggttttatcacgaggatatcaccctggggagcaggtcggccccctctggaggaggagcctccttcaacctttccctgactgaagaacattctggaaactactcctgtgaggccaacaatggcctgggggcccagcgcagtgaggcggtgacactcaacttcacagtgcctactggggccagaagcaatcatcttacctcaggagtcattgaggggctgctcagcacccttggtccagccaccgtggccttattattttgctacggcctcaaaagaaaaataggaagacgttcagccagggatccactcaggagccttcccagccctctaccccaagagttcacctacctcaactcacctaccccagggcagctacagcctatatatgaaaatgtgaatgttgtaagtggggatgaggtttattcactggcgtactataaccagccggagcaggaatcagtagcagcagaaaccctggggacacatatggaggacaaggtttccttagacatctattccaggctgaggaaagcaaacattacagatgtggactatgaagatgctatgtaaggttatggaagattctgctctttgaaaaccatccatgaccccaagcctcaggcctgatatgttcttcagagatcctggggcattagctttccagtatacctcttctggatgccattctccatggcactattccttcatctactgtgaagtgaagttggcgcagccctgaagaaactacctaggagaactaatagacacaggagtgacagggactttgttatcagaaccagattcctgccggctcctttgaaaacaggtcatattgtgctcttctgtttacaagaggaaacaagatggaataaaagaaattgggatcttgggttggagggacagtgaagcttagagcacatgaactcaaggttagtgactctgcaggacttcacagagagagctgtgcccatcattcagtccaagtgctttctctgcccagacagcacagaactccagccccgctacttacatggatcatcgagtttccacctaaaatatgattctatttattttgagtcactgttaccaaattagaactaaaacaaagttacataaaaagttattgtgactccacttaattttagtgacgtatttttgtatatataggccaacctataccacatccaaaattatgtatctattacagcccctagaagctttataaatacagtgtgtcttcttttattcacaaaatttttgaaatcgtggtaatatggtttgaaacctgtatcttaattattttttttttaaattgagacagggtctcactctgtcactcaatctggaatgcagtggcacaatcttgcctcactgcaacgcctgcctctcaggctcaagcaaacctctcacctcagcctgctgagtagctgggactacaggcacatgccaccaaacttggccattttttgtcttacgtagagacaagatttcaccgttttgcccaggctggtctcaaactcctgggctcaagcaatgtattgaatttt

SEQ ID NO: 9611 - protein, 261 aa, Homo sapiens
MGKKTQRSLSAELEIPAVKESDAGKYYCRADNGHVPIQSKVVNIPVRIPVSRPVLTLRSPGAQAAVGDLLELHCEALRGSPPILYQFYHEDVTLGNSSAPSGGGASFNLSLTAEHSGNYSCEANNGLGAQCSEAVPVSISGPDGYRRDLMTAGVLWGLFGVLGFTGVALLLYALFHKISGESSATNEPRGASRPNPQEFTYSSPTPDMEELQPVYVNVGSVDVDVVYSQVWSMQQPESSANIRTLLENKDSQVIYSSVKKS

SEQ ID NO: 9612 - protein, 255 aa, Homo sapiens
MWEWKICNSHGARPFAEPAGWEFVNLLRHHKSFLIAPLCLSVPVSRPVLTLRSPGAQAAVGDLLELHCEALRGSPPILYQFYHEDVTLGNSSAPSGGGASFNLSLTAEHSGNYSCEANNGLGAQCSEAVPVSISGPDGYRRDLMTAGVLWGLFGVLGFTGVALLLYALFHKISGESSATNEPRGASRPNPQEFTYSSPTPDMEELQPVYVNVGSVDVDVVYSQVWSMQQPESSANIRTLLENKDSQVIYSSVKKS

SEQ ID NO: 9613 - protein, 34 aa, Homo sapiens
MGKKTQRSLSAELEIPAVKESDAGKYYCRADGCG

SEQ ID NO: 9614 - protein, 34 aa, Homo sapiens
NGHVPIQSKVVNIPVRIPVSRPVLTLRSPGAGCG

SEQ ID NO: 9615 - protein, 34 aa, Homo sapiens
QAAVGDLLELHCEALRGSPPILYQFYHEDVTGCG

SEQ ID NO: 9616 - protein, 34 aa, Homo sapiens
LGNSSAPSGGGASFNLSLTAEHSGNYSCEANGCG

SEQ ID NO: 9617 - protein, 35 aa, Homo sapiens
NGLGAQCSEAVPVSISGPDGYRRDLMTAGVLWGCG

SEQ ID NO: 9618 - protein, 9 aa, Homo sapiens
GVLWGLFGV

SEQ ID NO: 9619 - protein, 9 aa, Homo sapiens
LLYALFHKI

SEQ ID NO: 9620 - protein, 9 aa, Homo sapiens
GLFGVLGFT

SEQ ID NO: 9621 - protein, 9 aa, Homo sapiens
VVYSQVWSM

SEQ ID NO: 9622 - protein, 9 aa, Homo sapiens
VLGFTGVAL

SEQ ID NO: 9623 - protein, 9 aa, Homo sapiens
VLWGLFGVL

SEQ ID NO: 9624 - protein, 9 aa, Homo sapiens
YVNVGSVDV

SEQ ID NO: 9625 - protein, 9 aa, Homo sapiens
MTAGVLWGL

SEQ ID NO: 9626 - protein, 9 aa, Homo sapiens
VLTLRSPGA

SEQ ID NO: 9627 - protein, 9 aa, Homo sapiens
ELQPVYVNV

SEQ ID NO: 9628 - protein, 9 aa, Homo sapiens
LLENKDSQV

SEQ ID NO: 9629 - protein, 9 aa, Homo sapiens
AQCSEAVPV

SEQ ID NO: 9630 - protein, 9 aa, Homo sapiens
NVGSVDVDV

SEQ ID NO: 9631 - protein, 9 aa, Homo sapiens
DLLELHCEA

SEQ ID NO: 9632 - protein, 9 aa, Homo sapiens
GLGAQCSEA

SEQ ID NO: 9633 - protein, 9 aa, Homo sapiens
QQPESSANI

SEQ ID NO: 9634 - protein, 9 aa, Homo sapiens
GVALLLYAL

SEQ ID NO: 9635 - protein, 9 aa, Homo sapiens
FGVLGFTGV

SEQ ID NO: 9636 - protein, 9 aa, Homo sapiens
SMQQPESSA

SEQ ID NO: 9637 - protein, 9 aa, Homo sapiens
KISGESSAT

SEQ ID NO: 9638 - protein, 9 aa, Homo sapiens
VLWGLFGVL

SEQ ID NO: 9639 - protein, 9 aa, Homo sapiens
GVLWGLFGV

SEQ ID NO: 9640 - protein, 9 aa, Homo sapiens
GVALLLYAL

SEQ ID NO: 9641 - protein, 9 aa, Homo sapiens
VVYSQVWSM

SEQ ID NO: 9642 - protein, 9 aa, Homo sapiens
YVNVGSVDV

SEQ ID NO: 9643 - protein, 9 aa, Homo sapiens
VLGFTGVAL

SEQ ID NO: 9644 - protein, 9 aa, Homo sapiens
LLYALFHKI

SEQ ID NO: 9645 - protein, 9 aa, Homo sapiens
RIPVSRPVL

SEQ ID NO: 9646 - protein, 9 aa, Homo sapiens
GLFGVLGFT

SEQ ID NO: 9647 - protein, 9 aa, Homo sapiens
KVVNIPVRI

SEQ ID NO: 9648 - protein, 9 aa, Homo sapiens
GVLGFTGVA

SEQ ID NO: 9649 - protein, 9 aa, Homo sapiens
NVGSVDVDV

SEQ ID NO: 9650 - protein, 9 aa, Homo sapiens
HVPIQSKVV

SEQ ID NO: 9651 - protein, 9 aa, Homo sapiens
YQFYHEDVT

SEQ ID NO: 9652 - protein, 9 aa, Homo sapiens
LGFTGVALL

SEQ ID NO: 9653 - protein, 9 aa, Homo sapiens
YSCEANNGL

SEQ ID NO: 9654 - protein, 9 aa, Homo sapiens
KISGESSAT

SEQ ID NO: 9655 - protein, 9 aa, Homo sapiens
MTAGVLWGL

SEQ ID NO: 9656 - protein, 9 aa, Homo sapiens
PVSRPVLTL

SEQ ID NO: 9657 - protein, 9 aa, Homo sapiens
AQAAVGDLL

SEQ ID NO: 9658 - protein, 9 aa, Homo sapiens
GFTGVALLL

SEQ ID NO: 9659 - protein, 9 aa, Homo sapiens
TYSSPTPDM

SEQ ID NO: 9660 - protein, 9 aa, Homo sapiens
QFYHEDVTL

SEQ ID NO: 9661 - protein, 9 aa, Homo sapiens
RIPVSRPVL

SEQ ID NO: 9662 - protein, 9 aa, Homo sapiens
LYQFYHEDV

SEQ ID NO: 9663 - protein, 9 aa, Homo sapiens
AAVGDLLEL

SEQ ID NO: 9664 - protein, 9 aa, Homo sapiens
LLELHCEAL

SEQ ID NO: 9665 - protein, 9 aa, Homo sapiens
GAQAAVGDL

SEQ ID NO: 9666 - protein, 9 aa, Homo sapiens
YSCEANNGL

SEQ ID NO: 9667 - protein, 9 aa, Homo sapiens
VLWGLFGVL

SEQ ID NO: 9668 - protein, 9 aa, Homo sapiens
MTAGVLWGL

SEQ ID NO: 9669 - protein, 9 aa, Homo sapiens
AQAAVGDLL

SEQ ID NO: 9670 - protein, 9 aa, Homo sapiens
SSANIRTLL

SEQ ID NO: 9671 - protein, 9 aa, Homo sapiens
TQRSLSAEL

SEQ ID NO: 9672 - protein, 9 aa, Homo sapiens
SPTPDMEEL

SEQ ID NO: 9673 - protein, 9 aa, Homo sapiens
GSPPILYQF

SEQ ID NO: 9674 - protein, 9 aa, Homo sapiens
LYALFHKIS

SEQ ID NO: 9675 - protein, 9 aa, Homo sapiens
GYRRDLMTA

SEQ ID NO: 9676 - protein, 9 aa, Homo sapiens
GVALLLYAL

SEQ ID NO: 9677 - protein, 9 aa, Homo sapiens
KVVNIPVRI

SEQ ID NO: 9678 - protein, 9 aa, Homo sapiens
LLLYALFHK

SEQ ID NO: 9679 - protein, 9 aa, Homo sapiens
LLYALFHKI

SEQ ID NO: 9680 - protein, 9 aa, Homo sapiens
VLWGLFGVL

SEQ ID NO: 9681 - protein, 9 aa, Homo sapiens
NIRTLLENK

SEQ ID NO: 9682 - protein, 9 aa, Homo sapiens
QVIYSSVKK

SEQ ID NO: 9683 - protein, 9 aa, Homo sapiens
AVKESDAGK

SEQ ID NO: 9684 - protein, 9 aa, Homo sapiens
SQVIYSSVK

SEQ ID NO: 9685 - protein, 9 aa, Homo sapiens
DMEELQPVY

SEQ ID NO: 9686 - protein, 9 aa, Homo sapiens
ALLLYALFH

SEQ ID NO: 9687 - protein, 9 aa, Homo sapiens
GLFGVLGFT

SEQ ID NO: 9688 - protein, 9 aa, Homo sapiens
ALRGSPPIL

SEQ ID NO: 9689 - protein, 9 aa, Homo sapiens
VVYSQVWSM

SEQ ID NO: 9690 - protein, 9 aa, Homo sapiens
GVALLLYAL

SEQ ID NO: 9691 - protein, 9 aa, Homo sapiens
FTGVALLLY

SEQ ID NO: 9692 - protein, 9 aa, Homo sapiens
GLGAQCSEA

SEQ ID NO: 9693 - protein, 9 aa, Homo sapiens
VLGFTGVAI

SEQ ID NO: 9694 - protein, 9 aa, Homo sapiens
LLELHCEAL

SEQ ID NO: 9695 - protein, 9 aa, Homo sapiens
KVVNIPVRI

SEQ ID NO: 9696 - protein, 9 aa, Homo sapiens
GVLWGLFGV

SEQ ID NO: 9697 - protein, 9 aa, Homo sapiens
MTAGVLWGL

SEQ ID NO: 9698 - protein, 9 aa, Homo sapiens
QVIYSSVKK

SEQ ID NO: 9699 - protein, 9 aa, Homo sapiens
AVKESDAGK

SEQ ID NO: 9700 - protein, 9 aa, Homo sapiens
ISGPDGYRR

SEQ ID NO: 9701 - protein, 9 aa, Homo sapiens
ESSATNEPR

SEQ ID NO: 9702 - protein, 9 aa, Homo sapiens
VSRPVLTLR

SEQ ID NO: 9703 - protein, 9 aa, Homo sapiens
DVTLGNSSA

SEQ ID NO: 9704 - protein, 9 aa, Homo sapiens
NVGSVDVDV

SEQ ID NO: 9705 - protein, 9 aa, Homo sapiens
DVDVVYSQV

SEQ ID NO: 9706 - protein, 9 aa, Homo sapiens
IPVRIPVSR

SEQ ID NO: 9707 - protein, 9 aa, Homo sapiens
LLLYALFHK

SEQ ID NO: 9708 - protein, 9 aa, Homo sapiens
GVLWGLFGV

SEQ ID NO: 9709 - protein, 9 aa, Homo sapiens
GVALLLYAL

SEQ ID NO: 9710 - protein, 9 aa, Homo sapiens
KVVNIPVRI

SEQ ID NO: 9711 - protein, 9 aa, Homo sapiens
AVGDLLELH

SEQ ID NO: 9712 - protein, 9 aa, Homo sapiens
GVLGFTGVA

SEQ ID NO: 9713 - protein, 9 aa, Homo sapiens
SISGPDGYR

SEQ ID NO: 9714 - protein, 9 aa, Homo sapiens
SQVIYSSVK

SEQ ID NO: 9715 - protein, 9 aa, Homo sapiens
QPESSANIR

SEQ ID NO: 9716 - protein, 9 aa, Homo sapiens
LELHCEALR

SEQ ID NO: 9717 - protein, 9 aa, Homo sapiens
HVPIQSKVV

SEQ ID NO: 9718 - protein, 9 aa, Homo sapiens
QVIYSSVKK

SEQ ID NO: 9719 - protein, 9 aa, Homo sapiens
AVKESDAGK

SEQ ID NO: 9720 - protein, 9 aa, Homo sapiens
LLLYALFHK

SEQ ID NO: 9721 - protein, 9 aa, Homo sapiens
SQVIYSSVK

SEQ ID NO: 9722 - protein, 9 aa, Homo sapiens
NIRTLLENK

SEQ ID NO: 9723 - protein, 9 aa, Homo sapiens
GVLWGLFGV

SEQ ID NO: 9724 - protein, 9 aa, Homo sapiens
GVALLLYAL

SEQ ID NO: 9725 - protein, 9 aa, Homo sapiens
KVVNIPVRI

SEQ ID NO: 9726 - protein, 9 aa, Homo sapiens
GVLGFTGVA

SEQ ID NO: 9727 - protein, 9 aa, Homo sapiens
AELEIPAVK

SEQ ID NO: 9728 - protein, 9 aa, Homo sapiens
SISGPDGYR

SEQ ID NO: 9729 - protein, 9 aa, Homo sapiens
VVYSQVWSM

SEQ ID NO: 9730 - protein, 9 aa, Homo sapiens
IPVRIPVSR

SEQ ID NO: 9731 - protein, 9 aa, Homo sapiens
QPESSANIR

SEQ ID NO: 9732 - protein, 9 aa, Homo sapiens
GYRRDLMTA

SEQ ID NO: 9733 - protein, 9 aa, Homo sapiens
NVGSVDVDV

SEQ ID NO: 9734 - protein, 9 aa, Homo sapiens
MTAGVLWGL

SEQ ID NO: 9735 - protein, 9 aa, Homo sapiens
YVNVGSVDV

SEQ ID NO: 9736 - protein, 9 aa, Homo sapiens
FTGVALLLY

SEQ ID NO: 9737 - protein, 9 aa, Homo sapiens
NGHVPIQSK

SEQ ID NO: 9738 - protein, 9 aa, Homo sapiens
LLLYALFHK

SEQ ID NO: 9739 - protein, 9 aa, Homo sapiens
SISGPDGYR

SEQ ID NO: 9740 - protein, 9 aa, Homo sapiens
VVYSQVWSM

SEQ ID NO: 9741 - protein, 9 aa, Homo sapiens
QVIYSSVKK

SEQ ID NO: 9742 - protein, 9 aa, Homo sapiens
SQVIYSSVK

SEQ ID NO: 9743 - protein, 9 aa, Homo sapiens
NIRTLLENK

SEQ ID NO: 9744 - protein, 9 aa, Homo sapiens
IPVRIPVSR

SEQ ID NO: 9745 - protein, 9 aa, Homo sapiens
GVLWGLFGV

SEQ ID NO: 9746 - protein, 9 aa, Homo sapiens
GVALLLYAL

SEQ ID NO: 9747 - protein, 9 aa, Homo sapiens
AVKESDAGK

SEQ ID NO: 9748 - protein, 9 aa, Homo sapiens
QPESSANIR

SEQ ID NO: 9749 - protein, 9 aa, Homo sapiens
LLYALFHKI

SEQ ID NO: 9750 - protein, 9 aa, Homo sapiens
KVVNIPVRI

SEQ ID NO: 9751 - protein, 9 aa, Homo sapiens
VLWGLFGVL

SEQ ID NO: 9752 - protein, 9 aa, Homo sapiens
ISGPDGYRR

SEQ ID NO: 9753 - protein, 9 aa, Homo sapiens
SDAGKYYCR

SEQ ID NO: 9754 - protein, 9 aa, Homo sapiens
MTAGVLWGL

SEQ ID NO: 9755 - protein, 9 aa, Homo sapiens
ALLLYALFH

SEQ ID NO: 9756 - protein, 9 aa, Homo sapiens
SKVVNIPVR

SEQ ID NO: 9757 - protein, 9 aa, Homo sapiens
RIPVSRPVL

SEQ ID NO: 9758 - protein, 9 aa, Homo sapiens
ESSATNEPR

SEQ ID NO: 9759 - protein, 9 aa, Homo sapiens
SISGPDGYR

SEQ ID NO: 9760 - protein, 9 aa, Homo sapiens
VSRPVLTLR

SEQ ID NO: 9761 - protein, 9 aa, Homo sapiens
ISGPDGYRR

SEQ ID NO: 9762 - protein, 9 aa, Homo sapiens
QPESSANIR

SEQ ID NO: 9763 - protein, 9 aa, Homo sapiens
TNEPRGASR

SEQ ID NO: 9764 - protein, 9 aa, Homo sapiens
IPVRIPVSR

SEQ ID NO: 9765 - protein, 9 aa, Homo sapiens
DVTLGNSSA

SEQ ID NO: 9766 - protein, 9 aa, Homo sapiens
DSQVIYSSV

SEQ ID NO: 9767 - protein, 9 aa, Homo sapiens
ESSANIRTL

SEQ ID NO: 9768 - protein, 9 aa, Homo sapiens
DVDVVYSQV

SEQ ID NO: 9769 - protein, 9 aa, Homo sapiens
DVVYSQVWS

SEQ ID NO: 9770 - protein, 9 aa, Homo sapiens
ESDAGKYYC

SEQ ID NO: 9771 - protein, 9 aa, Homo sapiens
ELQPVYVNV

SEQ ID NO: 9772 - protein, 9 aa, Homo sapiens
DLLELHCEA

SEQ ID NO: 9773 - protein, 9 aa, Homo sapiens
NVGSVDVDV

SEQ ID NO: 9774 - protein, 9 aa, Homo sapiens
SVDVDVVYS

SEQ ID NO: 9775 - protein, 9 aa, Homo sapiens
LYQFYHEDV

SEQ ID NO: 9776 - protein, 9 aa, Homo sapiens
TYSSPTPDM

SEQ ID NO: 9777 - protein, 9 aa, Homo sapiens
NIPVRIPVS

SEQ ID NO: 9778 - protein, 9 aa, Homo sapiens
VRIPVSRPV

SEQ ID NO: 9779 - protein, 9 aa, Homo sapiens
RIPVSRPVL

SEQ ID NO: 9780 - protein, 9 aa, Homo sapiens
LGFTGVALL

SEQ ID NO: 9781 - protein, 9 aa, Homo sapiens
AAVGDLLEL

SEQ ID NO: 9782 - protein, 9 aa, Homo sapiens
ESSANIRTL

SEQ ID NO: 9783 - protein, 9 aa, Homo sapiens
SSANIRTLL

SEQ ID NO: 9784 - protein, 9 aa, Homo sapiens
DGYRRDLMT

SEQ ID NO: 9785 - protein, 9 aa, Homo sapiens
RRDLMTAGV

SEQ ID NO: 9786 - protein, 9 aa, Homo sapiens
NIPVRIPVS

SEQ ID NO: 9787 - protein, 9 aa, Homo sapiens
EALRGSPPI

SEQ ID NO: 9788 - protein, 9 aa, Homo sapiens
GVLWGLFGV

SEQ ID NO: 9789 - protein, 9 aa, Homo sapiens
GVALLLYAL

SEQ ID NO: 9790 - protein, 9 aa, Homo sapiens
VNIPVRIPV

SEQ ID NO: 9791 - protein, 9 aa, Homo sapiens
MTAGVLWGL

SEQ ID NO: 9792 - protein, 9 aa, Homo sapiens
VLWGLFGVL

SEQ ID NO: 9793 - protein, 9 aa, Homo sapiens
GAQAAVGDL

SEQ ID NO: 9794 - protein, 9 aa, Homo sapiens
VVYSQVWSM

SEQ ID NO: 9795 - protein, 9 aa, Homo sapiens
SPTPDMEEL

SEQ ID NO: 9796 - protein, 9 aa, Homo sapiens
SRPNPQEFT

SEQ ID NO: 9797 - protein, 9 aa, Homo sapiens
SRPVLTLRS

SEQ ID NO: 9798 - protein, 9 aa, Homo sapiens
CEANNGLGA

SEQ ID NO: 9799 - protein, 9 aa, Homo sapiens
LEIPAVKES

SEQ ID NO: 9800 - protein, 9 aa, Homo sapiens
QEFTYSSPT

SEQ ID NO: 9801 - protein, 9 aa, Homo sapiens
SEAVPVSIS

SEQ ID NO: 9802 - protein, 9 aa, Homo sapiens
VDVVYSQVW

SEQ ID NO: 9803 - protein, 9 aa, Homo sapiens
AEHSGNYSC

SEQ ID NO: 9804 - protein, 9 aa, Homo sapiens
RDLMTAGVL

SEQ ID NO: 9805 - protein, 9 aa, Homo sapiens
ASFNLSLTA

SEQ ID NO: 9806 - protein, 9 aa, Homo sapiens
LENKDSQVI

SEQ ID NO: 9807 - protein, 9 aa, Homo sapiens
AAVGDLLEL

SEQ ID NO: 9808 - protein, 9 aa, Homo sapiens
KESDAGKYY

SEQ ID NO: 9809 - protein, 9 aa, Homo sapiens
EELQPVYVN

SEQ ID NO: 9810 - protein, 9 aa, Homo sapiens
LGFTGVALL

SEQ ID NO: 9811 - protein, 9 aa, Homo sapiens
EDVTLGNSS

SEQ ID NO: 9812 - protein, 9 aa, Homo sapiens
TGVALLLYA

SEQ ID NO: 9813 - protein, 9 aa, Homo sapiens
HEDVTLGNS

SEQ ID NO: 9814 - protein, 9 aa, Homo sapiens
GGASFNLSL

SEQ ID NO: 9815 - protein, 9 aa, Homo sapiens
SSAPSGGGA

SEQ ID NO: 9816 - protein, 9 aa, Homo sapiens
MEELQPVYV

SEQ ID NO: 9817 - protein, 9 aa, Homo sapiens
AELEIPAVK

SEQ ID NO: 9818 - protein, 9 aa, Homo sapiens
RDLMTAGVL

SEQ ID NO: 9819 - protein, 9 aa, Homo sapiens
AAVGDLLEL

SEQ ID NO: 9820 - protein, 9 aa, Homo sapiens
MEELQPVYV

SEQ ID NO: 9821 - protein, 9 aa, Homo sapiens
GGASFNLSL

SEQ ID NO: 9822 - protein, 9 aa, Homo sapiens
CEANNGLGA

SEQ ID NO: 9823 - protein, 9 aa, Homo sapiens
SSANIRTLL

SEQ ID NO: 9824 - protein, 9 aa, Homo sapiens
MTAGVLWGL

SEQ ID NO: 9825 - protein, 9 aa, Homo sapiens
LENKDSQVI

SEQ ID NO: 9826 - protein, 9 aa, Homo sapiens
ESSANIRTL

SEQ ID NO: 9827 - protein, 9 aa, Homo sapiens
AEHSGNYSC

SEQ ID NO: 9828 - protein, 9 aa, Homo sapiens
EELQPVYVN

SEQ ID NO: 9829 - protein, 9 aa, Homo sapiens
AQAAVGDLL

SEQ ID NO: 9830 - protein, 9 aa, Homo sapiens
YSCEANNGL

SEQ ID NO: 9831 - protein, 9 aa, Homo sapiens
QEFTYSSPT

SEQ ID NO: 9832 - protein, 9 aa, Homo sapiens
MGKKTQRSL

SEQ ID NO: 9833 - protein, 9 aa, Homo sapiens
LGFTGVALL

SEQ ID NO: 9834 - protein, 9 aa, Homo sapiens
SGGGASFNL

SEQ ID NO: 9835 - protein, 9 aa, Homo sapiens
GPDGYRRDL

SEQ ID NO: 9836 - protein, 9 aa, Homo sapiens
GAQAAVGDL

SEQ ID NO: 9837 - protein, 9 aa, Homo sapiens
SPTPDMEEL

SEQ ID NO: 9838 - protein, 9 aa, Homo sapiens
CEANNGLGA

SEQ ID NO: 9839 - protein, 9 aa, Homo sapiens
MEELQPVYV

SEQ ID NO: 9840 - protein, 9 aa, Homo sapiens
QEFTYSSPT

SEQ ID NO: 9841 - protein, 9 aa, Homo sapiens
LENKDSQVI

SEQ ID NO: 9842 - protein, 9 aa, Homo sapiens
AEHSGNYSC

SEQ ID NO: 9843 - protein, 9 aa, Homo sapiens
EELQPVYVN

SEQ ID NO: 9844 - protein, 9 aa, Homo sapiens
RDLMTAGVL

SEQ ID NO: 9845 - protein, 9 aa, Homo sapiens
LGAQCSEAV

SEQ ID NO: 9846 - protein, 9 aa, Homo sapiens
FGVLGFTGV

SEQ ID NO: 9847 - protein, 9 aa, Homo sapiens
VNIPVRIPV

SEQ ID NO: 9848 - protein, 9 aa, Homo sapiens
SAELEIPAV

SEQ ID NO: 9849 - protein, 9 aa, Homo sapiens
SEAVPVSIS

SEQ ID NO: 9850 - protein, 9 aa, Homo sapiens
LEIPAVKES

SEQ ID NO: 9851 - protein, 9 aa, Homo sapiens
ASFNLSLTA

SEQ ID NO: 9852 - protein, 9 aa, Homo sapiens
RSPGAQAAV

SEQ ID NO: 9853 - protein, 9 aa, Homo sapiens
TGVALLLYA

SEQ ID NO: 9854 - protein, 9 aa, Homo sapiens
PDMEELQPV

SEQ ID NO: 9855 - protein, 9 aa, Homo sapiens
YCRADNGHV

SEQ ID NO: 9856 - protein, 9 aa, Homo sapiens
IPAVKESDA

SEQ ID NO: 9857 - protein, 9 aa, Homo sapiens
LSAELEIPA

SEQ ID NO: 9858 - protein, 9 aa, Homo sapiens
TQRSLSAEL

SEQ ID NO: 9859 - protein, 9 aa, Homo sapiens
TAGVLWGLF

SEQ ID NO: 9860 - protein, 9 aa, Homo sapiens
AQAAVGDLL

SEQ ID NO: 9861 - protein, 9 aa, Homo sapiens
ALRGSPPIL

SEQ ID NO: 9862 - protein, 9 aa, Homo sapiens
DLMTAGVLW

SEQ ID NO: 9863 - protein, 9 aa, Homo sapiens
TLRSPGAQA

SEQ ID NO: 9864 - protein, 9 aa, Homo sapiens
ELQPVYVNV

SEQ ID NO: 9865 - protein, 9 aa, Homo sapiens
VLWGLFGVL

SEQ ID NO: 9866 - protein, 9 aa, Homo sapiens
GLFGVLGFT

SEQ ID NO: 9867 - protein, 9 aa, Homo sapiens
FTGVALLLY

SEQ ID NO: 9868 - protein, 9 aa, Homo sapiens
APSGGGASF

SEQ ID NO: 9869 - protein, 9 aa, Homo sapiens
WGLFGVLGF

SEQ ID NO: 9870 - protein, 9 aa, Homo sapiens
AQCSEAVPV

SEQ ID NO: 9871 - protein, 9 aa, Homo sapiens
VLGFTGVAL

SEQ ID NO: 9872 - protein, 9 aa, Homo sapiens
QQPESSANI

SEQ ID NO: 9873 - protein, 9 aa, Homo sapiens
DLLELHCEA

SEQ ID NO: 9874 - protein, 9 aa, Homo sapiens
GLGAQCSEA

SEQ ID NO: 9875 - protein, 9 aa, Homo sapiens
LLYALFHKI

SEQ ID NO: 9876 - protein, 9 aa, Homo sapiens
VALLLYALF

SEQ ID NO: 9877 - protein, 9 aa, Homo sapiens
SPPILYQFY

SEQ ID NO: 9878 - protein, 9 aa, Homo sapiens
ALRGSPPIL

SEQ ID NO: 9879 - protein, 9 aa, Homo sapiens
SPTPDMEEL

SEQ ID NO: 9880 - protein, 9 aa, Homo sapiens
TQRSLSAEL

SEQ ID NO: 9881 - protein, 9 aa, Homo sapiens
GPDGYRRDL

SEQ ID NO: 9882 - protein, 9 aa, Homo sapiens
AAVGDLLEL

SEQ ID NO: 9883 - protein, 9 aa, Homo sapiens
GVALLLYAL

SEQ ID NO: 9884 - protein, 9 aa, Homo sapiens
AQAAVGDLL

SEQ ID NO: 9885 - protein, 9 aa, Homo sapiens
GAQAAVGDL

SEQ ID NO: 9886 - protein, 9 aa, Homo sapiens
SSANIRTLL

SEQ ID NO: 9887 - protein, 9 aa, Homo sapiens
RIPVSRPVL

SEQ ID NO: 9888 - protein, 9 aa, Homo sapiens
VVYSQVWSM

SEQ ID NO: 9889 - protein, 9 aa, Homo sapiens
SGGGASFNL

SEQ ID NO: 9890 - protein, 9 aa, Homo sapiens
MGKKTQRSL

SEQ ID NO: 9891 - protein, 9 aa, Homo sapiens
YSCEANNGL

SEQ ID NO: 9892 - protein, 9 aa, Homo sapiens
ESSANIRTL

SEQ ID NO: 9893 - protein, 9 aa, Homo sapiens
LGFTGVALL

SEQ ID NO: 9894 - protein, 9 aa, Homo sapiens
GGASFNLSL

SEQ ID NO: 9895 - protein, 9 aa, Homo sapiens
VLGFTGVAL

SEQ ID NO: 9896 - protein, 9 aa, Homo sapiens
MTAGVLWGL

SEQ ID NO: 9897 - protein, 9 aa, Homo sapiens
EPRGASRPN

SEQ ID NO: 9898 - protein, 9 aa, Homo sapiens
ALRGSPPIL

SEQ ID NO: 9899 - protein, 9 aa, Homo sapiens
TQRSLSAEL

SEQ ID NO: 9900 - protein, 9 aa, Homo sapiens
EPRGASRPN

SEQ ID NO: 9901 - protein, 9 aa, Homo sapiens
GAQAAVGDL

SEQ ID NO: 9902 - protein, 9 aa, Homo sapiens
IPVSRPVLT

SEQ ID NO: 9903 - protein, 9 aa, Homo sapiens
IPAVKESDA

SEQ ID NO: 9904 - protein, 9 aa, Homo sapiens
MGKKTQRSL

SEQ ID NO: 9905 - protein, 9 aa, Homo sapiens
QSKVVNIPV

SEQ ID NO: 9906 - protein, 9 aa, Homo sapiens
YCRADNGHV

SEQ ID NO: 9907 - protein, 9 aa, Homo sapiens
ESSANIRTL

SEQ ID NO: 9908 - protein, 9 aa, Homo sapiens
VLTLRSPGA

SEQ ID NO: 9909 - protein, 9 aa, Homo sapiens
VLGFTGVAL

SEQ ID NO: 9910 - protein, 9 aa, Homo sapiens
TLRSPGAQA

SEQ ID NO: 9911 - protein, 9 aa, Homo sapiens
EALRGSPPI

SEQ ID NO: 9912 - protein, 9 aa, Homo sapiens
VLWGLFGVL

SEQ ID NO: 9913 - protein, 9 aa, Homo sapiens
ENKDSQVIY

SEQ ID NO: 9914 - protein, 9 aa, Homo sapiens
YSCEANNGL

SEQ ID NO: 9915 - protein, 9 aa, Homo sapiens
LLENKDSQV

SEQ ID NO: 9916 - protein, 9 aa, Homo sapiens
MTAGVLWGL

SEQ ID NO: 9917 - protein, 9 aa, Homo sapiens
SSANIRTLL

SEQ ID NO: 9918 - protein, 9 aa, Homo sapiens
LRGSPPILY

SEQ ID NO: 9919 - protein, 9 aa, Homo sapiens
RRDLMTAGV

SEQ ID NO: 9920 - protein, 9 aa, Homo sapiens
SRPNPQEFT

SEQ ID NO: 9921 - protein, 9 aa, Homo sapiens
LRSPGAQAA

SEQ ID NO: 9922 - protein, 9 aa, Homo sapiens
YQFYHEDVT

SEQ ID NO: 9923 - protein, 9 aa, Homo sapiens
SRPVLTLRS

SEQ ID NO: 9924 - protein, 9 aa, Homo sapiens
VRIPVSRPV

SEQ ID NO: 9925 - protein, 9 aa, Homo sapiens
QQPESSANI

SEQ ID NO: 9926 - protein, 9 aa, Homo sapiens
AQAAVGDLL

SEQ ID NO: 9927 - protein, 9 aa, Homo sapiens
TQRSLSAEL

SEQ ID NO: 9928 - protein, 9 aa, Homo sapiens
VLWGLFGVL

SEQ ID NO: 9929 - protein, 9 aa, Homo sapiens
LLYALFHKI

SEQ ID NO: 9930 - protein, 9 aa, Homo sapiens
RPNPQEFTY

SEQ ID NO: 9931 - protein, 9 aa, Homo sapiens
KESDAGKYY

SEQ ID NO: 9932 - protein, 9 aa, Homo sapiens
AQCSEAVPV

SEQ ID NO: 9933 - protein, 9 aa, Homo sapiens
IRTLLENKD

SEQ ID NO: 9934 - protein, 9 aa, Homo sapiens
QRSLSAELE

SEQ ID NO: 9935 - protein, 9 aa, Homo sapiens
YRRDLMTAG

SEQ ID NO: 9936 - protein, 9 aa, Homo sapiens
CRADNGHVP

SEQ ID NO: 9937 - protein, 9 aa, Homo sapiens
QEFTYSSPT

SEQ ID NO: 9938 - protein, 9 aa, Homo sapiens
RRDLMTAGV

SEQ ID NO: 9939 - protein, 9 aa, Homo sapiens
LRGSPPILY

SEQ ID NO: 9940 - protein, 9 aa, Homo sapiens
TQRSLSAEL

SEQ ID NO: 9941 - protein, 9 aa, Homo sapiens
SQVIYSSVK

SEQ ID NO: 9942 - protein, 9 aa, Homo sapiens
LRSPGAQAA

SEQ ID NO: 9943 - protein, 9 aa, Homo sapiens
AQAAVGDLL

SEQ ID NO: 9944 - protein, 9 aa, Homo sapiens
SRPVLTLRS

SEQ ID NO: 9945 - protein, 9 aa, Homo sapiens
SRPNPQEFT

SEQ ID NO: 9946 - protein, 9 aa, Homo sapiens
VRIPVSRPV

SEQ ID NO: 9947 - protein, 9 aa, Homo sapiens
VLWGLFGVL

SEQ ID NO: 9948 - protein, 9 aa, Homo sapiens
YQFYHEDVT

SEQ ID NO: 9949 - protein, 9 aa, Homo sapiens
AQCSEAVPV

SEQ ID NO: 9950 - protein, 9 aa, Homo sapiens
QQPESSANI

SEQ ID NO: 9951 - protein, 9 aa, Homo sapiens
LLYALFHKI

SEQ ID NO: 9952 - protein, 9 aa, Homo sapiens
RIPVSRPVL

SEQ ID NO: 9953 - protein, 9 aa, Homo sapiens
LLELHCEAL

SEQ ID NO: 9954 - protein, 9 aa, Homo sapiens
ALRGSPPIL

SEQ ID NO: 9955 - protein, 9 aa, Homo sapiens
LLLYALFHK

SEQ ID NO: 9956 - protein, 9 aa, Homo sapiens
AELEIPAVK

SEQ ID NO: 9957 - protein, 9 aa, Homo sapiens
VLGFTGVAL

SEQ ID NO: 9958 - protein, 9 aa, Homo sapiens
RPNPQEFTY

SEQ ID NO: 9959 - protein, 9 aa, Homo sapiens
SPPILYQFY

SEQ ID NO: 9960 - protein, 9 aa, Homo sapiens
SPTPDMEEL

SEQ ID NO: 9961 - protein, 9 aa, Homo sapiens
GSVDVDVVY

SEQ ID NO: 9962 - protein, 9 aa, Homo sapiens
APSGGGASF

SEQ ID NO: 9963 - protein, 9 aa, Homo sapiens
ASRPNPQEF

SEQ ID NO: 9964 - protein, 9 aa, Homo sapiens
ENKDSQVIY

SEQ ID NO: 9965 - protein, 9 aa, Homo sapiens
YSCEANNGL

SEQ ID NO: 9966 - protein, 9 aa, Homo sapiens
VSISGPDGY

SEQ ID NO: 9967 - protein, 9 aa, Homo sapiens
EPRGASRPN

SEQ ID NO: 9968 - protein, 9 aa, Homo sapiens
GPDGYRRDL

SEQ ID NO: 9969 - protein, 9 aa, Homo sapiens
GSPPILYQF

SEQ ID NO: 9970 - protein, 9 aa, Homo sapiens
ESSANIRTL

SEQ ID NO: 9971 - protein, 9 aa, Homo sapiens
SSANIRTLL

SEQ ID NO: 9972 - protein, 9 aa, Homo sapiens
AAVGDLLEL

SEQ ID NO: 9973 - protein, 9 aa, Homo sapiens
LTAEHSGNY

SEQ ID NO: 9974 - protein, 9 aa, Homo sapiens
NPQEFTYSS

SEQ ID NO: 9975 - protein, 9 aa, Homo sapiens
RSLSAELEI

SEQ ID NO: 9976 - protein, 9 aa, Homo sapiens
TAGVLWGLF

SEQ ID NO: 9977 - protein, 9 aa, Homo sapiens
QSKVVNIPV

SEQ ID NO: 9978 - protein, 9 aa, Homo sapiens
RDLMTAGVL

SEQ ID NO: 9979 - protein, 9 aa, Homo sapiens
LENKDSQVI

SEQ ID NO: 9980 - protein, 9 aa, Homo sapiens
SSANIRTLL

SEQ ID NO: 9981 - protein, 9 aa, Homo sapiens
AQAAVGDLL

SEQ ID NO: 9982 - protein, 9 aa, Homo sapiens
GFTGVALLL

SEQ ID NO: 9983 - protein, 9 aa, Homo sapiens
KDSQVIYSS

SEQ ID NO: 9984 - protein, 9 aa, Homo sapiens
LGFTGVALL

SEQ ID NO: 9985 - protein, 9 aa, Homo sapiens
VDVVYSQVW

SEQ ID NO: 9986 - protein, 9 aa, Homo sapiens
PDGYRRDLM

SEQ ID NO: 9987 - protein, 9 aa, Homo sapiens
EDVTLGNSS

SEQ ID NO: 9988 - protein, 9 aa, Homo sapiens
KESDAGKYY

SEQ ID NO: 9989 - protein, 9 aa, Homo sapiens
MEELQPVYV

SEQ ID NO: 9990 - protein, 9 aa, Homo sapiens
KVVNIPVRI

SEQ ID NO: 9991 - protein, 9 aa, Homo sapiens
MTAGVLWGL

SEQ ID NO: 9992 - protein, 9 aa, Homo sapiens
CSEAVPVSI

SEQ ID NO: 9993 - protein, 9 aa, Homo sapiens
SGGGASFNL

SEQ ID NO: 9994 - protein, 9 aa, Homo sapiens
EALRGSPPI

SEQ ID NO: 9995 - protein, 9 aa, Homo sapiens
AEHSGNYSC

SEQ ID NO: 9996 - protein, 9 aa, Homo sapiens
AAVGDLLEL

SEQ ID NO: 9997 - protein, 9 aa, Homo sapiens
LRGSPPILY

SEQ ID NO: 9998 - protein, 9 aa, Homo sapiens
YHEDVTLGN

SEQ ID NO: 9999 - protein, 9 aa, Homo sapiens
GPDGYRRDL

SEQ ID NO: 10000 - protein, 9 aa, Homo sapiens
GHVPIQSKV

SEQ ID NO: 10001 - protein, 9 aa, Homo sapiens
LHCEALRGS

SEQ ID NO: 10002 - protein, 9 aa, Homo sapiens
GFTGVALLL

SEQ ID NO: 10003 - protein, 9 aa, Homo sapiens
APSGGGASF

SEQ ID NO: 10004 - protein, 9 aa, Homo sapiens
LLELHCEAL

SEQ ID NO: 10005 - protein, 9 aa, Homo sapiens
MTAGVLWGL

SEQ ID NO: 10006 - protein, 9 aa, Homo sapiens
VLWGLFGVL

SEQ ID NO: 10007 - protein, 9 aa, Homo sapiens
YSCEANNGL

SEQ ID NO: 10008 - protein, 9 aa, Homo sapiens
SGGGASFNL

SEQ ID NO: 10009 - protein, 9 aa, Homo sapiens
SPTPDMEEL

SEQ ID NO: 10010 - protein, 9 aa, Homo sapiens
AAVGDLLEL

SEQ ID NO: 10011 - protein, 9 aa, Homo sapiens
QFYHEDVTL

SEQ ID NO: 10012 - protein, 9 aa, Homo sapiens
GAQAAVGDL

SEQ ID NO: 10013 - protein, 9 aa, Homo sapiens
TAGVLWGLF

SEQ ID NO: 10014 - protein, 9 aa, Homo sapiens
GVALLLYAL

SEQ ID NO: 10015 - protein, 9 aa, Homo sapiens
SSANIRTLL

SEQ ID NO: 10016 - protein, 9 aa, Homo sapiens
AQAAVGDLL

SEQ ID NO: 10017 - protein, 9 aa, Homo sapiens
GSPPILYQF

SEQ ID NO: 10018 - protein, 9 aa, Homo sapiens
GHVPIQSKV

SEQ ID NO: 10019 - protein, 9 aa, Homo sapiens
YHEDVTLGN

SEQ ID NO: 10020 - protein, 9 aa, Homo sapiens
RRDLMTAGV

SEQ ID NO: 10021 - protein, 9 aa, Homo sapiens
VRIPVSRPV

SEQ ID NO: 10022 - protein, 9 aa, Homo sapiens
AAVGDLLEL

SEQ ID NO: 10023 - protein, 9 aa, Homo sapiens
LGFTGVALL

SEQ ID NO: 10024 - protein, 9 aa, Homo sapiens
LHCEALRGS

SEQ ID NO: 10025 - protein, 9 aa, Homo sapiens
LLELHCEAL

SEQ ID NO: 10026 - protein, 9 aa, Homo sapiens
YSCEANNGL

SEQ ID NO: 10027 - protein, 9 aa, Homo sapiens
VLWGLFGVL

SEQ ID NO: 10028 - protein, 9 aa, Homo sapiens
SAELEIPAV

SEQ ID NO: 10029 - protein, 9 aa, Homo sapiens
GPDGYRRDL

SEQ ID NO: 10030 - protein, 9 aa, Homo sapiens
MTAGVLWGL

SEQ ID NO: 10031 - protein, 9 aa, Homo sapiens
GAQAAVGDL

SEQ ID NO: 10032 - protein, 9 aa, Homo sapiens
GVALLLYAL

SEQ ID NO: 10033 - protein, 9 aa, Homo sapiens
ESSANIRTL

SEQ ID NO: 10034 - protein, 9 aa, Homo sapiens
SPTPDMEEL

SEQ ID NO: 10035 - protein, 9 aa, Homo sapiens
DVDVVYSQV

SEQ ID NO: 10036 - protein, 9 aa, Homo sapiens
VVYSQVWSM

SEQ ID NO: 10037 - protein, 9 aa, Homo sapiens
QFYHEDVTL

SEQ ID NO: 10038 - protein, 9 aa, Homo sapiens
AQAAVGDLL

SEQ ID NO: 10039 - protein, 9 aa, Homo sapiens
TQRSLSAEL

SEQ ID NO: 10040 - protein, 9 aa, Homo sapiens
GGASFNLSL

SEQ ID NO: 10041 - protein, 9 aa, Homo sapiens
GVALLLYAL

SEQ ID NO: 10042 - protein, 9 aa, Homo sapiens
GPDGYRRDL

SEQ ID NO: 10043 - protein, 9 aa, Homo sapiens
MTAGVLWGL

SEQ ID NO: 10044 - protein, 9 aa, Homo sapiens
SSANIRTLL

SEQ ID NO: 10045 - protein, 9 aa, Homo sapiens
VLWGLFGVL

SEQ ID NO: 10046 - protein, 9 aa, Homo sapiens
GFTGVALLL

SEQ ID NO: 10047 - protein, 9 aa, Homo sapiens
LGFTGVALL

SEQ ID NO: 10048 - protein, 9 aa, Homo sapiens
RIPVSRPVL

SEQ ID NO: 10049 - protein, 9 aa, Homo sapiens
LLELHCEAL

SEQ ID NO: 10050 - protein, 9 aa, Homo sapiens
YSCEANNGL

SEQ ID NO: 10051 - protein, 9 aa, Homo sapiens
ESSANIRTL

SEQ ID NO: 10052 - protein, 9 aa, Homo sapiens
GAQAAVGDL

SEQ ID NO: 10053 - protein, 9 aa, Homo sapiens
SPTPDMEEL

SEQ ID NO: 10054 - protein, 9 aa, Homo sapiens
AAVGDLLEL

SEQ ID NO: 10055 - protein, 9 aa, Homo sapiens
QFYHEDVTL

SEQ ID NO: 10056 - protein, 9 aa, Homo sapiens
VLGFTGVAL

SEQ ID NO: 10057 - protein, 9 aa, Homo sapiens
SGGGASFNL

SEQ ID NO: 10058 - protein, 9 aa, Homo sapiens
KESDAGKYY

SEQ ID NO: 10059 - protein, 9 aa, Homo sapiens
LEIPAVKES

SEQ ID NO: 10060 - protein, 9 aa, Homo sapiens
SEAVPVSIS

SEQ ID NO: 10061 - protein, 9 aa, Homo sapiens
VSISGPDGY

SEQ ID NO: 10062 - protein, 9 aa, Homo sapiens
GSVDVDVVY

SEQ ID NO: 10063 - protein, 9 aa, Homo sapiens
SPPILYQFY

SEQ ID NO: 10064 - protein, 9 aa, Homo sapiens
RPNPQEFTY

SEQ ID NO: 10065 - protein, 9 aa, Homo sapiens
CEANNGLGA

SEQ ID NO: 10066 - protein, 9 aa, Homo sapiens
AEHSGNYSC

SEQ ID NO: 10067 - protein, 9 aa, Homo sapiens
EELQPVYVN

SEQ ID NO: 10068 - protein, 9 aa, Homo sapiens
FTGVALLLY

SEQ ID NO: 10069 - protein, 9 aa, Homo sapiens
WGLFGVLGF

SEQ ID NO: 10070 - protein, 9 aa, Homo sapiens
LTAEHSGNY

SEQ ID NO: 10071 - protein, 9 aa, Homo sapiens
HEDVTLGNS

SEQ ID NO: 10072 - protein, 9 aa, Homo sapiens
QEFTYSSPT

SEQ ID NO: 10073 - protein, 9 aa, Homo sapiens
LENKDSQVI

SEQ ID NO: 10074 - protein, 9 aa, Homo sapiens
ASRPNPQEF

SEQ ID NO: 10075 - protein, 9 aa, Homo sapiens
MEELQPVYV

SEQ ID NO: 10076 - protein, 9 aa, Homo sapiens
GSPPILYQF

SEQ ID NO: 10077 - protein, 9 aa, Homo sapiens
APSGGGASF

SEQ ID NO: 10078 - protein, 9 aa, Homo sapiens
EALRGSPPI

SEQ ID NO: 10079 - protein, 9 aa, Homo sapiens
GPDGYRRDL

SEQ ID NO: 10080 - protein, 9 aa, Homo sapiens
RADNGHVPI

SEQ ID NO: 10081 - protein, 9 aa, Homo sapiens
SPTPDMEEL

SEQ ID NO: 10082 - protein, 9 aa, Homo sapiens
SAELEIPAV

SEQ ID NO: 10083 - protein, 9 aa, Homo sapiens
AAVGDLLEL

SEQ ID NO: 10084 - protein, 9 aa, Homo sapiens
VGSVDVDVV

SEQ ID NO: 10085 - protein, 9 aa, Homo sapiens
FGVLGFTGV

SEQ ID NO: 10086 - protein, 9 aa, Homo sapiens
LGAQCSEAV

SEQ ID NO: 10087 - protein, 9 aa, Homo sapiens
LGFTGVALL

SEQ ID NO: 10088 - protein, 9 aa, Homo sapiens
GAQAAVGDL

SEQ ID NO: 10089 - protein, 9 aa, Homo sapiens
MGKKTQRSL

SEQ ID NO: 10090 - protein, 9 aa, Homo sapiens
SGGGASFNL

SEQ ID NO: 10091 - protein, 9 aa, Homo sapiens
GGASFNLSL

SEQ ID NO: 10092 - protein, 9 aa, Homo sapiens
IPAVKESDA

SEQ ID NO: 10093 - protein, 9 aa, Homo sapiens
EPRGASRPN

SEQ ID NO: 10094 - protein, 9 aa, Homo sapiens
IPVSRPVLT

SEQ ID NO: 10095 - protein, 9 aa, Homo sapiens
DAGKYYCRA

SEQ ID NO: 10096 - protein, 9 aa, Homo sapiens
LLYALFHKI

SEQ ID NO: 10097 - protein, 9 aa, Homo sapiens
DGYRRDLMT

SEQ ID NO: 10098 - protein, 9 aa, Homo sapiens
EALRGSPPI

SEQ ID NO: 10099 - protein, 9 aa, Homo sapiens
FGVLGFTGV

SEQ ID NO: 10100 - protein, 9 aa, Homo sapiens
AAVGDLLEL

SEQ ID NO: 10101 - protein, 9 aa, Homo sapiens
LGFTGVALL

SEQ ID NO: 10102 - protein, 9 aa, Homo sapiens
RADNGHVPI

SEQ ID NO: 10103 - protein, 9 aa, Homo sapiens
SPTPDMEEL

SEQ ID NO: 10104 - protein, 9 aa, Homo sapiens
GPDGYRRDL

SEQ ID NO: 10105 - protein, 9 aa, Homo sapiens
SAELEIPAV

SEQ ID NO: 10106 - protein, 9 aa, Homo sapiens
GAQAAVGDL

SEQ ID NO: 10107 - protein, 9 aa, Homo sapiens
LGAQCSEAV

SEQ ID NO: 10108 - protein, 9 aa, Homo sapiens
LLYALFHKI

SEQ ID NO: 10109 - protein, 9 aa, Homo sapiens
VGSVDVDVV

SEQ ID NO: 10110 - protein, 9 aa, Homo sapiens
IPVSRPVLT

SEQ ID NO: 10111 - protein, 9 aa, Homo sapiens
KVVNIPVRI

SEQ ID NO: 10112 - protein, 9 aa, Homo sapiens
SGGGASFNL

SEQ ID NO: 10113 - protein, 9 aa, Homo sapiens
GGASFNLSL

SEQ ID NO: 10114 - protein, 9 aa, Homo sapiens
QPVYVNVGS

SEQ ID NO: 10115 - protein, 9 aa, Homo sapiens
VPIQSKVVN

SEQ ID NO: 10116 - protein, 9 aa, Homo sapiens
MGKKTQRSL

SEQ ID NO: 10117 - protein, 9 aa, Homo sapiens
RSLSAELEI

SEQ ID NO: 10118 - protein, 9 aa, Homo sapiens
RADNGHVPI

SEQ ID NO: 10119 - protein, 9 aa, Homo sapiens
EALRGSPPI

SEQ ID NO: 10120 - protein, 9 aa, Homo sapiens
SAELEIPAV

SEQ ID NO: 10121 - protein, 9 aa, Homo sapiens
FGVLGFTGV

SEQ ID NO: 10122 - protein, 9 aa, Homo sapiens
VGSVDVDVV

SEQ ID NO: 10123 - protein, 9 aa, Homo sapiens
LGAQCSEAV

SEQ ID NO: 10124 - protein, 9 aa, Homo sapiens
GAQAAVGDL

SEQ ID NO: 10125 - protein, 9 aa, Homo sapiens
AAVGDLLEL

SEQ ID NO: 10126 - protein, 9 aa, Homo sapiens
LGFTGVALL

SEQ ID NO: 10127 - protein, 9 aa, Homo sapiens
DGYRRDLMT

SEQ ID NO: 10128 - protein, 9 aa, Homo sapiens
GPDGYRRDL

SEQ ID NO: 10129 - protein, 9 aa, Homo sapiens
SGGGASFNL

SEQ ID NO: 10130 - protein, 9 aa, Homo sapiens
MGKKTQRSL

SEQ ID NO: 10131 - protein, 9 aa, Homo sapiens
SPTPDMEEL

SEQ ID NO: 10132 - protein, 9 aa, Homo sapiens
GGASFNLSL

SEQ ID NO: 10133 - protein, 9 aa, Homo sapiens
LLYALFHKI

SEQ ID NO: 10134 - protein, 9 aa, Homo sapiens
DAGKYYCRA

SEQ ID NO: 10135 - protein, 9 aa, Homo sapiens
GASFNLSLT

SEQ ID NO: 10136 - protein, 9 aa, Homo sapiens
SATNEPRGA

SEQ ID NO: 10137 - protein, 9 aa, Homo sapiens
DVDVVYSQV

SEQ ID NO: 10138 - protein, 9 aa, Homo sapiens
VGSVDVDVV

SEQ ID NO: 10139 - protein, 9 aa, Homo sapiens
YQFYHEDVT

SEQ ID NO: 10140 - protein, 9 aa, Homo sapiens
VLWGLFGVL

SEQ ID NO: 10141 - protein, 9 aa, Homo sapiens
HVPIQSKVV

SEQ ID NO: 10142 - protein, 9 aa, Homo sapiens
QQPESSANI

SEQ ID NO: 10143 - protein, 9 aa, Homo sapiens
LENKDSQVI

SEQ ID NO: 10144 - protein, 9 aa, Homo sapiens
LLYALFHKI

SEQ ID NO: 10145 - protein, 9 aa, Homo sapiens
LGFTGVALL

SEQ ID NO: 10146 - protein, 9 aa, Homo sapiens
AQCSEAVPV

SEQ ID NO: 10147 - protein, 9 aa, Homo sapiens
LGAQCSEAV

SEQ ID NO: 10148 - protein, 9 aa, Homo sapiens
FGVLGFTGV

SEQ ID NO: 10149 - protein, 9 aa, Homo sapiens
SPPILYQFY

SEQ ID NO: 10150 - protein, 9 aa, Homo sapiens
WGLFGVLGF

SEQ ID NO: 10151 - protein, 9 aa, Homo sapiens
DGYRRDLMT

SEQ ID NO: 10152 - protein, 9 aa, Homo sapiens
VNIPVRIPV

SEQ ID NO: 10153 - protein, 9 aa, Homo sapiens
RDLMTAGVL

SEQ ID NO: 10154 - protein, 9 aa, Homo sapiens
DVDVVYSQV

SEQ ID NO: 10155 - protein, 9 aa, Homo sapiens
RIPVSRPVL

SEQ ID NO: 10156 - protein, 9 aa, Homo sapiens
AQAAVGDLL

SEQ ID NO: 10157 - protein, 9 aa, Homo sapiens
APSGGGASF

SEQ ID NO: 10158 - protein, 9 aa, Homo sapiens
GSPPILYQF

SEQ ID NO: 10159 - protein, 9 aa, Homo sapiens
ASRPNPQEF

SEQ ID NO: 10160 - protein, 9 aa, Homo sapiens
VALLLYALF

SEQ ID NO: 10161 - protein, 9 aa, Homo sapiens
TAGVLWGLF

SEQ ID NO: 10162 - protein, 9 aa, Homo sapiens
LTAEHSGNY

SEQ ID NO: 10163 - protein, 9 aa, Homo sapiens
GSVDVDVVY

SEQ ID NO: 10164 - protein, 9 aa, Homo sapiens
FTGVALLLY

SEQ ID NO: 10165 - protein, 9 aa, Homo sapiens
RSLSAELEI

SEQ ID NO: 10166 - protein, 9 aa, Homo sapiens
RSPGAQAAV

SEQ ID NO: 10167 - protein, 9 aa, Homo sapiens
VSISGPDGY

SEQ ID NO: 10168 - protein, 9 aa, Homo sapiens
LSAELEIPA

SEQ ID NO: 10169 - protein, 9 aa, Homo sapiens
YSCEANNGL

SEQ ID NO: 10170 - protein, 9 aa, Homo sapiens
SSAPSGGGA

SEQ ID NO: 10171 - protein, 9 aa, Homo sapiens
ASFNLSLTA

SEQ ID NO: 10172 - protein, 9 aa, Homo sapiens
MTAGVLWGL

SEQ ID NO: 10173 - protein, 9 aa, Homo sapiens
RADNGHVPI

SEQ ID NO: 10174 - protein, 9 aa, Homo sapiens
QSKVVNIPV

SEQ ID NO: 10175 - protein, 9 aa, Homo sapiens
SSANTRTLL

SEQ ID NO: 10176 - protein, 9 aa, Homo sapiens
CSEAVPVSI

SEQ ID NO: 10177 - protein, 9 aa, Homo sapiens
WGLFGVLGF

SEQ ID NO: 10178 - protein, 9 aa, Homo sapiens
VALLLYALF

SEQ ID NO: 10179 - protein, 9 aa, Homo sapiens
AAVGDLLEL

SEQ ID NO: 10180 - protein, 9 aa, Homo sapiens
LLYALFHKI

SEQ ID NO: 10181 - protein, 9 aa, Homo sapiens
RDLMTAGVL

SEQ ID NO: 10182 - protein, 9 aa, Homo sapiens
SPTPDMEEL

SEQ ID NO: 10183 - protein, 9 aa, Homo sapiens
EALRGSPPI

SEQ ID NO: 10184 - protein, 9 aa, Homo sapiens
QFYHEDVTL

SEQ ID NO: 10185 - protein, 9 aa, Homo sapiens
VRIPVSRPV

SEQ ID NO: 10186 - protein, 9 aa, Homo sapiens
VLWGLFGVL

SEQ ID NO: 10187 - protein, 9 aa, Homo sapiens
GHVPIQSKV

SEQ ID NO: 10188 - protein, 9 aa, Homo sapiens
LGFTGVALL

SEQ ID NO: 10189 - protein, 9 aa, Homo sapiens
KVVNIPVRI

SEQ ID NO: 10190 - protein, 9 aa, Homo sapiens
FGVLGFTGV

SEQ ID NO: 10191 - protein, 9 aa, Homo sapiens
VVYSQVWSM

SEQ ID NO: 10192 - protein, 9 aa, Homo sapiens
WGLFGVLGF

SEQ ID NO: 10193 - protein, 9 aa, Homo sapiens
GAQAAVGDL

SEQ ID NO: 10194 - protein, 9 aa, Homo sapiens
YSCEANNGL

SEQ ID NO: 10195 - protein, 9 aa, Homo sapiens
ESSANIRTL

SEQ ID NO: 10196 - protein, 9 aa, Homo sapiens
VNIPVRIPV

SEQ ID NO: 10197 - protein, 9 aa, Homo sapiens
GSPPILYQF

SEQ ID NO: 10198 - protein, 9 aa, Homo sapiens
QFYHEDVTL

SEQ ID NO: 10199 - protein, 9 aa, Homo sapiens
GFTGVALLL

SEQ ID NO: 10200 - protein, 9 aa, Homo sapiens
GPDGYRRDL

SEQ ID NO: 10201 - protein, 9 aa, Homo sapiens
SPTPDMEEL

SEQ ID NO: 10202 - protein, 9 aa, Homo sapiens
TYSSPTPDM

SEQ ID NO: 10203 - protein, 9 aa, Homo sapiens
APSGGGASF

SEQ ID NO: 10204 - protein, 9 aa, Homo sapiens
LYQFYHEDV

SEQ ID NO: 10205 - protein, 9 aa, Homo sapiens
RPNPQEFTY

SEQ ID NO: 10206 - protein, 9 aa, Homo sapiens
GYRRDLMTA

SEQ ID NO: 10207 - protein, 9 aa, Homo sapiens
SPPILYQFY

SEQ ID NO: 10208 - protein, 9 aa, Homo sapiens
LGFTGVALL

SEQ ID NO: 10209 - protein, 9 aa, Homo sapiens
GAQAAVGDL

SEQ ID NO: 10210 - protein, 9 aa, Homo sapiens
MTAGVLWGL

SEQ ID NO: 10211 - protein, 9 aa, Homo sapiens
GVALLLYAL

SEQ ID NO: 10212 - protein, 9 aa, Homo sapiens
AAVGDLLEL

SEQ ID NO: 10213 - protein, 9 aa, Homo sapiens
ESSANIRTL

SEQ ID NO: 10214 - protein, 9 aa, Homo sapiens
MGKKTQRSL

SEQ ID NO: 10215 - protein, 9 aa, Homo sapiens
YSCEANNGL

SEQ ID NO: 10216 - protein, 9 aa, Homo sapiens
GSPPILYQF

SEQ ID NO: 10217 - protein, 9 aa, Homo sapiens
VLGFTGVAL

SEQ ID NO: 10218 - protein, 9 aa, Homo sapiens
GVALLLYAL

SEQ ID NO: 10219 - protein, 9 aa, Homo sapiens
TQRSLSAEL

SEQ ID NO: 10220 - protein, 9 aa, Homo sapiens
SSANIRTLL

SEQ ID NO: 10221 - protein, 9 aa, Homo sapiens
VLWGLFGVL

SEQ ID NO: 10222 - protein, 9 aa, Homo sapiens
GGASFNLSL

SEQ ID NO: 10223 - protein, 9 aa, Homo sapiens
AAVGDLLEL

SEQ ID NO: 10224 - protein, 9 aa, Homo sapiens
ESSANIRTL

SEQ ID NO: 10225 - protein, 9 aa, Homo sapiens
GAQAAVGDL

SEQ ID NO: 10226 - protein, 9 aa, Homo sapiens
MTAGVLWGL

SEQ ID NO: 10227 - protein, 9 aa, Homo sapiens
LGFTGVALL

SEQ ID NO: 10228 - protein, 9 aa, Homo sapiens
SPPILYQFY

SEQ ID NO: 10229 - protein, 9 aa, Homo sapiens
RRDLMTAGV

SEQ ID NO: 10230 - protein, 9 aa, Homo sapiens
KVVNIPVRI

SEQ ID NO: 10231 - protein, 9 aa, Homo sapiens
DMEELQPVY

SEQ ID NO: 10232 - protein, 9 aa, Homo sapiens
LLYALFHKI

SEQ ID NO: 10233 - protein, 9 aa, Homo sapiens
GHVPIQSKV

SEQ ID NO: 10234 - protein, 9 aa, Homo sapiens
DSQVIYSSV

SEQ ID NO: 10235 - protein, 9 aa, Homo sapiens
GPDGYRRDL

SEQ ID NO: 10236 - protein, 9 aa, Homo sapiens
YSCEANNGL

SEQ ID NO: 10237 - protein, 9 aa, Homo sapiens
SPTPDMEEL

SEQ ID NO: 10238 - protein, 9 aa, Homo sapiens
SPPILYQFY

SEQ ID NO: 10239 - protein, 9 aa, Homo sapiens
RPNPQEFTY

SEQ ID NO: 10240 - protein, 9 aa, Homo sapiens
FTGVALLLY

SEQ ID NO: 10241 - protein, 9 aa, Homo sapiens
LRGSPPILY

SEQ ID NO: 10242 - protein, 9 aa, Homo sapiens
GSVDVDVVY

SEQ ID NO: 10243 - protein, 9 aa, Homo sapiens
GSPPILYQF

SEQ ID NO: 10244 - protein, 9 aa, Homo sapiens
DMEELQPVY

SEQ ID NO: 10245 - protein, 9 aa, Homo sapiens
LTAEHSGNY

SEQ ID NO: 10246 - protein, 9 aa, Homo sapiens
GVALLLYAL

SEQ ID NO: 10247 - protein, 9 aa, Homo sapiens
ENKDSQVIY

SEQ ID NO: 10248 - protein, 9 aa, Homo sapiens
KESDAGKYY

SEQ ID NO: 10249 - protein, 9 aa, Homo sapiens
MTAGVLWGL

SEQ ID NO: 10250 - protein, 9 aa, Homo sapiens
TAGVLWGLF

SEQ ID NO: 10251 - protein, 9 aa, Homo sapiens
VALLLYALF

SEQ ID NO: 10252 - protein, 9 aa, Homo sapiens
VSISGPDGY

SEQ ID NO: 10253 - protein, 9 aa, Homo sapiens
APSGGGASF

SEQ ID NO: 10254 - protein, 9 aa, Homo sapiens
SSANIRTLL

SEQ ID NO: 10255 - protein, 9 aa, Homo sapiens
GGASFNLSL

SEQ ID NO: 10256 - protein, 9 aa, Homo sapiens
LYALFHKIS

SEQ ID NO: 10257 - protein, 9 aa, Homo sapiens
AQAAVGDLL

SEQ ID NO: 10258 - protein, 9 aa, Homo sapiens
ESSANIRTL

SEQ ID NO: 10259 - protein, 9 aa, Homo sapiens
GASFNLSLT

SEQ ID NO: 10260 - protein, 9 aa, Homo sapiens
AAVGDLLEL

SEQ ID NO: 10261 - protein, 9 aa, Homo sapiens
CEANNGLGA

SEQ ID NO: 10262 - protein, 9 aa, Homo sapiens
RSLSAELEI

SEQ ID NO: 10263 - protein, 9 aa, Homo sapiens
EALRGSPPI

SEQ ID NO: 10264 - protein, 9 aa, Homo sapiens
QQPESSANI

SEQ ID NO: 10265 - protein, 9 aa, Homo sapiens
RIPVSRPVL

SEQ ID NO: 10266 - protein, 9 aa, Homo sapiens
KVVNIPVRI

SEQ ID NO: 10267 - protein, 9 aa, Homo sapiens
RDLMTAGVL

SEQ ID NO: 10268 - protein, 9 aa, Homo sapiens
SKVVNIPVR

SEQ ID NO: 10269 - protein, 9 aa, Homo sapiens
TLLENKDSQ

SEQ ID NO: 10270 - protein, 9 aa, Homo sapiens
VILGNSSAP

SEQ ID NO: 10271 - protein, 9 aa, Homo sapiens
YSCEANNGL

SEQ ID NO: 10272 - protein, 9 aa, Homo sapiens
SGGGASFNL

SEQ ID NO: 10273 - protein, 9 aa, Homo sapiens
SSANIRTLL

SEQ ID NO: 10274 - protein, 9 aa, Homo sapiens
VLWGLFGVL

SEQ ID NO: 10275 - protein, 9 aa, Homo sapiens
LGFTGVALL

SEQ ID NO: 10276 - protein, 9 aa, Homo sapiens
GAQAAVGDL

SEQ ID NO: 10277 - protein, 9 aa, Homo sapiens
GGASFNLSL

SEQ ID NO: 10278 - protein, 9 aa, Homo sapiens
SSANIRTLL

SEQ ID NO: 10279 - protein, 9 aa, Homo sapiens
ESSANIRTL

SEQ ID NO: 10280 - protein, 9 aa, Homo sapiens
AAVGDLLEL

SEQ ID NO: 10281 - protein, 9 aa, Homo sapiens
GASFNLSLT

SEQ ID NO: 10282 - protein, 9 aa, Homo sapiens
TLLENKDSQ

SEQ ID NO: 10283 - protein, 9 aa, Homo sapiens
RSLSAELEI

SEQ ID NO: 10284 - protein, 9 aa, Homo sapiens
AQAAVGDLL

SEQ ID NO: 10285 - protein, 9 aa, Homo sapiens
YSCEANNGL

SEQ ID NO: 10286 - protein, 9 aa, Homo sapiens
GVALLLYAL

SEQ ID NO: 10287 - protein, 9 aa, Homo sapiens
GAQAAVGDL

SEQ ID NO: 10288 - protein, 9 aa, Homo sapiens
SGGGASFNL

SEQ ID NO: 10289 - protein, 9 aa, Homo sapiens
TQRSLSAEL

SEQ ID NO: 10290 - protein, 9 aa, Homo sapiens
VVYSQVWSM

SEQ ID NO: 10291 - protein, 9 aa, Homo sapiens
ASRPNPQEF

SEQ ID NO: 10292 - protein, 9 aa, Homo sapiens
QQPESSANI

SEQ ID NO: 10293 - protein, 9 aa, Homo sapiens
PVYVNVGSV

SEQ ID NO: 10294 - protein, 9 aa, Homo sapiens
GGASFNLSL

SEQ ID NO: 10295 - protein, 9 aa, Homo sapiens
LGFTGVALL

SEQ ID NO: 10296 - protein, 9 aa, Homo sapiens
RIPVSRPVL

SEQ ID NO: 10297 - protein, 9 aa, Homo sapiens
KVVNIPVRI

SEQ ID NO: 10298 - protein, 9 aa, Homo sapiens
SGGGASFNL

SEQ ID NO: 10299 - protein, 9 aa, Homo sapiens
MGKKTQRSL

SEQ ID NO: 10300 - protein, 9 aa, Homo sapiens
GGASFNLSL

SEQ ID NO: 10301 - protein, 9 aa, Homo sapiens
LGFTGVALL

SEQ ID NO: 10302 - protein, 9 aa, Homo sapiens
QQPESSANI

SEQ ID NO: 10303 - protein, 9 aa, Homo sapiens
NIPVRIPVS

SEQ ID NO: 10304 - protein, 9 aa, Homo sapiens
LGAQCSEAV

SEQ ID NO: 10305 - protein, 9 aa, Homo sapiens
FGVLGFTGV

SEQ ID NO: 10306 - protein, 9 aa, Homo sapiens
VGSVDVDVV

SEQ ID NO: 10307 - protein, 9 aa, Homo sapiens
WGLFGVLGF

SEQ ID NO: 10308 - protein, 9 aa, Homo sapiens
HVPIQSKVV

SEQ ID NO: 10309 - protein, 9 aa, Homo sapiens
RIPVSRPVL

SEQ ID NO: 10310 - protein, 9 aa, Homo sapiens
DGYRRDLMT

SEQ ID NO: 10311 - protein, 9 aa, Homo sapiens
RSPGAQAAV

SEQ ID NO: 10312 - protein, 9 aa, Homo sapiens
GSPPILYQF

SEQ ID NO: 10313 - protein, 9 aa, Homo sapiens
SGPDGYRRD

SEQ ID NO: 10314 - protein, 9 aa, Homo sapiens
GAQAAVGDL

SEQ ID NO: 10315 - protein, 9 aa, Homo sapiens
SRPNPQEFT

SEQ ID NO: 10316 - protein, 9 aa, Homo sapiens
SGNYSCEAN

SEQ ID NO: 10317 - protein, 9 aa, Homo sapiens
SPPILYQFY

SEQ ID NO: 10318 - protein, 9 aa, Homo sapiens
LLYALFHKI

SEQ ID NO: 10319 - protein, 9 aa, Homo sapiens
VLWGLFGVL

SEQ ID NO: 10320 - protein, 9 aa, Homo sapiens
DSQVIYSSV

SEQ ID NO: 10321 - protein, 9 aa, Homo sapiens
ELQPVYVNV

SEQ ID NO: 10322 - protein, 9 aa, Homo sapiens
VVYSQVWSM

SEQ ID NO: 10323 - protein, 9 aa, Homo sapiens
LGFTGVALL

SEQ ID NO: 10324 - protein, 9 aa, Homo sapiens
GAQAAVGDL

SEQ ID NO: 10325 - protein, 9 aa, Homo sapiens
DAGKYYCRA

SEQ ID NO: 10326 - protein, 9 aa, Homo sapiens
SPPILYQFY

SEQ ID NO: 10327 - protein, 9 aa, Homo sapiens
TYSSPTPDM

SEQ ID NO: 10328 - protein, 9 aa, Homo sapiens
SGGGASFNL

SEQ ID NO: 10329 - protein, 9 aa, Homo sapiens
YSCEANNGL

SEQ ID NO: 10330 - protein, 9 aa, Homo sapiens
GGGASFNLS

SEQ ID NO: 10331 - protein, 9 aa, Homo sapiens
FGVLGFTGV

SEQ ID NO: 10332 - protein, 9 aa, Homo sapiens
GGASFNLSL

SEQ ID NO: 10333 - protein, 9 aa, Homo sapiens
QQPESSANI

SEQ ID NO: 10334 - protein, 9 aa, Homo sapiens
AAVGDLLEL

SEQ ID NO: 10335 - protein, 9 aa, Homo sapiens
SPTPDMEEL

SEQ ID NO: 10336 - protein, 9 aa, Homo sapiens
AQAAVGDLL

SEQ ID NO: 10337 - protein, 9 aa, Homo sapiens
RDLMTAGVL

SEQ ID NO: 10338 - protein, 9 aa, Homo sapiens
QFYHEDVTL

SEQ ID NO: 10339 - protein, 9 aa, Homo sapiens
GFTGVALLL

SEQ ID NO: 10340 - protein, 9 aa, Homo sapiens
LYQFYHEDV

SEQ ID NO: 10341 - protein, 9 aa, Homo sapiens
TYSSPTPDM

SEQ ID NO: 10342 - protein, 9 aa, Homo sapiens
KVVNIPVRI

SEQ ID NO: 10343 - protein, 9 aa, Homo sapiens
AAVGDLLEL

SEQ ID NO: 10344 - protein, 9 aa, Homo sapiens
EALRGSPPI

SEQ ID NO: 10345 - protein, 9 aa, Homo sapiens
RSLSAELEI

SEQ ID NO: 10346 - protein, 9 aa, Homo sapiens
AQAAVGDLL

SEQ ID NO: 10347 - protein, 9 aa, Homo sapiens
SSANIRTLL

SEQ ID NO: 10348 - protein, 9 aa, Homo sapiens
QQPESSANI

SEQ ID NO: 10349 - protein, 9 aa, Homo sapiens
LLYALFHKI

SEQ ID NO: 10350 - protein, 9 aa, Homo sapiens
GYRRDLMTA

SEQ ID NO: 10351 - protein, 9 aa, Homo sapiens
CSEAVPVSI

SEQ ID NO: 10352 - protein, 9 aa, Homo sapiens
SPTPDMEEL

SEQ ID NO: 10353 - protein, 9 aa, Homo sapiens
ALRGSPPIL

SEQ ID NO: 10354 - protein, 9 aa, Homo sapiens
RADNGHVPI

SEQ ID NO: 10355 - protein, 9 aa, Homo sapiens
YSCEANNGL

SEQ ID NO: 10356 - protein, 9 aa, Homo sapiens
VLWGLFGVL

SEQ ID NO: 10357 - protein, 9 aa, Homo sapiens
ESSANIRTL

SEQ ID NO: 10358 - protein, 9 aa, Homo sapiens
LENKDSQVI

SEQ ID NO: 10359 - protein, 9 aa, Homo sapiens
MEELQPVYV

SEQ ID NO: 10360 - protein, 9 aa, Homo sapiens
AEHSGNYSC

SEQ ID NO: 10361 - protein, 9 aa, Homo sapiens
EELQPVYVN

SEQ ID NO: 10362 - protein, 9 aa, Homo sapiens
EALRGSPPI

SEQ ID NO: 10363 - protein, 9 aa, Homo sapiens
QEFTYSSPT

SEQ ID NO: 10364 - protein, 9 aa, Homo sapiens
SEAVPVSIS

SEQ ID NO: 10365 - protein, 9 aa, Homo sapiens
LLYALFHKI

SEQ ID NO: 10366 - protein, 9 aa, Homo sapiens
CEANNGLGA

SEQ ID NO: 10367 - protein, 9 aa, Homo sapiens
HEDVTLGNS

SEQ ID NO: 10368 - protein, 9 aa, Homo sapiens
CSEAVPVSI

SEQ ID NO: 10369 - protein, 9 aa, Homo sapiens
LEIPAVKES

SEQ ID NO: 10370 - protein, 9 aa, Homo sapiens
EDVTLGNSS

SEQ ID NO: 10371 - protein, 9 aa, Homo sapiens
RSLSAELEI

SEQ ID NO: 10372 - protein, 9 aa, Homo sapiens
RADNGHVPI

SEQ ID NO: 10373 - protein, 9 aa, Homo sapiens
QQPESSANI

SEQ ID NO: 10374 - protein, 9 aa, Homo sapiens
KVVNIPVRI

SEQ ID NO: 10375 - protein, 9 aa, Homo sapiens
KESDAGKYY

SEQ ID NO: 10376 - protein, 9 aa, Homo sapiens
VDVVYSQVW

SEQ ID NO: 10377 - protein, 9 aa, Homo sapiens
LELHCEALR

SEQ ID NO: 10378 - protein, 9 aa, Homo sapiens
LENKDSQVI

SEQ ID NO: 10379 - protein, 9 aa, Homo sapiens
MEELQPVYV

SEQ ID NO: 10380 - protein, 9 aa, Homo sapiens
AEHSGNYSC

SEQ ID NO: 10381 - protein, 9 aa, Homo sapiens
EELQPVYVN

SEQ ID NO: 10382 - protein, 9 aa, Homo sapiens
EALRGSPPI

SEQ ID NO: 10383 - protein, 9 aa, Homo sapiens
QEFTYSSPT

SEQ ID NO: 10384 - protein, 9 aa, Homo sapiens
SEAVPVSIS

SEQ ID NO: 10385 - protein, 9 aa, Homo sapiens
LLYALFHKI

SEQ ID NO: 10386 - protein, 9 aa, Homo sapiens
CEANNGLGA

SEQ ID NO: 10387 - protein, 9 aa, Homo sapiens
HEDVTLGNS

SEQ ID NO: 10388 - protein, 9 aa, Homo sapiens
CSEAVPVSI

SEQ ID NO: 10389 - protein, 9 aa, Homo sapiens
LEIPAVKES

SEQ ID NO: 10390 - protein, 9 aa, Homo sapiens
EDVTLGNSS

SEQ ID NO: 10391 - protein, 9 aa, Homo sapiens
RSLSAELEI

SEQ ID NO: 10392 - protein, 9 aa, Homo sapiens
RADNGHVPI

SEQ ID NO: 10393 - protein, 9 aa, Homo sapiens
QQPESSANI

SEQ ID NO: 10394 - protein, 9 aa, Homo sapiens
KVVNIPVRI

SEQ ID NO: 10395 - protein, 9 aa, Homo sapiens
KESDAGKYY

SEQ ID NO: 10396 - protein, 9 aa, Homo sapiens
VDVVYSQVW

SEQ ID NO: 10397 - protein, 9 aa, Homo sapiens
LELHCEALR

SEQ ID NO: 10398 - protein, 9 aa, Homo sapiens
APSGGGASF

SEQ ID NO: 10399 - protein, 9 aa, Homo sapiens
SPTPDMEEL

SEQ ID NO: 10400 - protein, 9 aa, Homo sapiens
GSPPILYQF

SEQ ID NO: 10401 - protein, 9 aa, Homo sapiens
SPPILYQFY

SEQ ID NO: 10402 - protein, 9 aa, Homo sapiens
RPNPQEFTY

SEQ ID NO: 10403 - protein, 9 aa, Homo sapiens
NPQEFTYSS

SEQ ID NO: 10404 - protein, 9 aa, Homo sapiens
GPDGYRRDL

SEQ ID NO: 10405 - protein, 9 aa, Homo sapiens
IPVSRPVLT

SEQ ID NO: 10406 - protein, 9 aa, Homo sapiens
VPIQSKVVN

SEQ ID NO: 10407 - protein, 8 aa, Homo sapiens
PVYVNVGS

SEQ ID NO: 10408 - protein, 9 aa, Homo sapiens
IPAVKESDA

SEQ ID NO: 10409 - protein, 9 aa, Homo sapiens
SSANIRTLL

SEQ ID NO: 10410 - protein, 9 aa, Homo sapiens
ESSANIRTL

SEQ ID NO: 10411 - protein, 9 aa, Homo sapiens
YSCEANNGL

SEQ ID NO: 10412 - protein, 9 aa, Homo sapiens
DSQVIYSSV

SEQ ID NO: 10413 - protein, 9 aa, Homo sapiens
RSPGAQAAV

SEQ ID NO: 10414 - protein, 9 aa, Homo sapiens
ASRPNPQEF

SEQ ID NO: 10415 - protein, 9 aa, Homo sapiens
WGLFGVLGF

SEQ ID NO: 10416 - protein, 9 aa, Homo sapiens
VSISGPDGY

SEQ ID NO: 10417 - protein, 9 aa, Homo sapiens
TAGVLWGLF

SEQ ID NO: 10418 - protein, 9 aa, Homo sapiens
SKVVNIPVR

SEQ ID NO: 10419 - protein, 9 aa, Homo sapiens
VKESDAGKY

SEQ ID NO: 10420 - protein, 9 aa, Homo sapiens
NKDSQVIYS

SEQ ID NO: 10421 - protein, 9 aa, Homo sapiens
KKTQRSLSA

SEQ ID NO: 10422 - protein, 9 aa, Homo sapiens
HKISGESSA

SEQ ID NO: 10423 - protein, 9 aa, Homo sapiens
GKYYCRADN

SEQ ID NO: 10424 - protein, 9 aa, Homo sapiens
GKKTQRSLS

SEQ ID NO: 10425 - protein, 9 aa, Homo sapiens
TNEPRGASR

SEQ ID NO: 10426 - protein, 9 aa, Homo sapiens
ESSATNEPR

SEQ ID NO: 10427 - protein, 9 aa, Homo sapiens
VSRPVLTLR

SEQ ID NO: 10428 - protein, 9 aa, Homo sapiens
SISGPDGYR

SEQ ID NO: 10429 - protein, 9 aa, Homo sapiens
IPVRIPVSR

SEQ ID NO: 10430 - protein, 9 aa, Homo sapiens
ISGPDGYRR

SEQ ID NO: 10431 - protein, 9 aa, Homo sapiens
QPESSANIR

SEQ ID NO: 10432 - protein, 9 aa, Homo sapiens
LLLYALFHK

SEQ ID NO: 10433 - protein, 9 aa, Homo sapiens
DMEELQPVY

SEQ ID NO: 10434 - protein, 9 aa, Homo sapiens
SQVIYSSVK

SEQ ID NO: 10435 - protein, 9 aa, Homo sapiens
VLWGLFGVL

SEQ ID NO: 10436 - protein, 9 aa, Homo sapiens
VLGFTGVAL

SEQ ID NO: 10437 - protein, 9 aa, Homo sapiens
LLELHCEAL

SEQ ID NO: 10438 - protein, 30 aa, Homo sapiens
MGKKTQRSLSAELEIPAVKESDAGKYYCRA

SEQ ID NO: 10439 - protein, 30 aa, Homo sapiens
PAVKESDAGKYYCRADNGHVPIQSKVVNIP

SEQ ID NO: 10440 - protein, 30 aa, Homo sapiens
DNGHVPIQSKVVNIPVRIPVSRPVLTLRSP

SEQ ID NO: 10441 - protein, 30 aa, Homo sapiens
VRIPVSRPVLTLRSPGAQAAVGDLLELHCE

SEQ ID NO: 10442 - protein, 30 aa, Homo sapiens
GAQAAVGDLLELHCEALRGSPPILYQFYHE

SEQ ID NO: 10443 - protein, 30 aa, Homo sapiens
ALRGSPPILYQFYHEDVTLGNSSAPSGGGA

SEQ ID NO: 10444 - protein, 30 aa, Homo sapiens
DVTLGNSSAPSGGGASFNLSLTAEHSGNYS

SEQ ID NO: 10445 - protein, 30 aa, Homo sapiens
SFNLSLTAEHSGNYSCEANNGLGAQCSEAV

SEQ ID NO: 10446 - protein, 30 aa, Homo sapiens
CEANNGLGAQCSEAVPVSISGPDGYRRDLM

SEQ ID NO: 10447 - protein, 30 aa, Homo sapiens
PVSISGPDGYRRDLMTAGVLWGLFGVLGFT

SEQ ID NO: 10448 - protein, 30 aa, Homo sapiens
TAGVLWGLFGVLGFTGVALLLYALFHKISG

SEQ ID NO: 10449 - protein, 30 aa, Homo sapiens
GVALLLYALFHKISGESSATNEPRGASRPN

SEQ ID NO: 10450 - protein, 30 aa, Homo sapiens
ESSATNEPRGASRPNPQEFTYSSPTPDMEE

SEQ ID NO: 10451 - protein, 30 aa, Homo sapiens
PQEFTYSSPTPDMEELQPVYVNVGSVDVDV

SEQ ID NO: 10452 - protein, 30 aa, Homo sapiens
LQPVYVNVGSVDVDVVYSQVWSMQQPESSA

SEQ ID NO: 10453 - protein, 30 aa, Homo sapiens
VYSQVWSMQQPESSANIRTLLENKDSQVIY

SEQ ID NO: 10454 - protein, 21 aa, Homo sapiens
NIRTLLENKDSQVIYSSVKKS

SEQ ID NO: 10455 - protein, 39 aa, Homo sapiens
KVVNIPVRIPVSRPVLTLRSPGAQAAVGDLLELHCEALR

SEQ ID NO: 10456 - protein, 24 aa, Homo sapiens
LGAQCSEAVPVSISGPDGYRRDLM

SEQ ID NO: 10457 - protein, 16 aa, Homo sapiens
ELQPVYVNVGSVDVDV

SEQ ID NO: 10458 - protein, 38 aa, Homo sapiens
GPDGYRRDLMTAGVLWGLFGVLGFTGVALLLYALFHKI

SEQ ID NO: 10459 - protein, 515 aa, Homo sapiens
MLLWASLLAFAPVCGQSAAAHKPVISVHPPWTTFFKGERVTLTCNGFQFYATEKTTWYHRHYWGEKLTLTPGNTLEVRESGLYRCQARGSPRSNPVRLLFSSDSLILQAPYSVFEGDTLVLRCHRRRKEKLTAVKYTWNGNILSISNKSWDLLIPQASSNNNGNYRCIGYGDENDVFRSNFKIIKIQELFPHPELKATDSQPTEGNSVNLSCETQLPPERSDTPLHFNFFRDGEVILSDWSTYPELQLPTVWRENSGSYWCGAETVRGNIHKHSPSLQIHVQRIPVSGVLLETQPSGGQAVEGEMLVLVCSVAEGTGDTTFSWHREDMQESLGRKTQRSLRAELELPAIRQSHAGGYYCTADNSYGPVQSMVLNVTVRETPGNRDGLVAAGATGGLLSALLLAVALLFHCWRRRKSGVGFLGDETRLPPAPGPGESSHSICPAQVELQSLYVDVHPKKGDLVYSEIQTTQLGEEEEANTSRTLLEDKDVSVVYSEVKTQHPDNSAGKISSKDEES

SEQ ID NO: 10460 - protein, 759 aa, Homo sapiens
MLLWVILLVLAPVSGQFARTPRPIIFLQPPWTTVFQGERVTLTCKGFRFYSPQKTKWYHRYLGKEILRETPDNILEVQESGEYRCQAQGSPLSSPVHLDFSSASLILQAPLSVFEGDSVVLRCRAKAEVTLNNTIYKNDNVLAFLNKRTDFHIPHACLKDNGAYRCTGYKESCCPVSSNTVKIQVQEPFTRPVLRASSFQPISGNPVTLTCETQLSLERSDVPLRFRFFRDDQTLGLGWSLSPNFQITAMWSKDSGFYWCKAATMPHSVISDSPRSWIQVQIPASHPVLTLSPEKALNFEGTKVTLHCETQEDSLRTLYRFYHEGVPLRHKSVRCERGASISFSLTTENSGNYYCTADNGLGAKPSKAVSLSVTVPVSHPVLNLSSPEDLIFEGAKVTLHCEAQRGSLPILYQFHHEDAALERRSANSAGGVAISFSLTAEHSGNYYCTADNGFGPQRSKAVSLSITVPVSHPVLTLSSAEALTFEGATVTLHCEVQRGSPQILYQFYHEDMPLWSSSTPSVGRVSFSFSLTEGHSGNYYCTADNGFGPQRSEVVSLFVTVPVSRPILTLRVPRAQAVVGDLLELHCEAPRGSPPILYWFYHEDVTLGSSSAPSGGEASFNLSLTAEHSGNYSCEANNGLVAQHSDTISLSVIVPVSRPILTFRAPRAQAVVGDLLELHCEALRGSSPILYWFYHEDVTLGKISAPSGGGASFNLSLTTEHSGIYSCEADNGLEAQRSEMVTLKVAGEWALPTSSTSEN

SEQ ID NO: 10461 - protein, 592 aa, Homo sapiens
MLLWVILLVLAPVSGQFARTPRPIIFLQPPWTTVFQGERVTLTCKGFRFYSPQKTKWYHRYLGKEILRETPDNILEVQESGEYRCQAQGSPLSSPVHLDFSSASLILQAPLSVFEGDSVVLRCRAKAEVTLNNTIYKNDNVLAFLNKRTDFHIPHACLKDNGAYRCTGYKESCCPVSSNTVKIQVQEPFTRPVLRASSFQPISGNPVTLTCETQLSLERSDVPLRFRFFRDDQTLGLGWSLSPNFQITAMWSKDSGFYWCKAATMPHSVISDSPRSWIQVQIPASHPVLTLSPEKALNFEGTKVTLHCETQEDSLRTLYRFYHEGVPLRHKSVRCERGASISFSLTTENSGNYYCTADNGLGAKPSKAVSLSVTVPVSHPVLNLSSPEDLIFEGAKVTLHCEAQRGSLPILYQFHHEDAALERRSANSAGGVAISFSLTAEHSGNYYCTADNGFGPQRSKAVSLSITVPVSHPVLTLSSAEALTFEGATVTLHCEVQRGSPQILYQFYHEDMPLWSSSTPSVGRVSFSFSLTEGHSGNYYCTADNGFGPQRSEVVSLFVTGKCWVLASHPPLAEFSLTHSFKNLFALSSFLP

SEQ ID NO: 10462 - protein, 977 aa, Homo sapiens
MLLWVILLVLAPVSGQFARTPRPIIFLQPPWTTVFQGERVTLTCKGFRFYSPQKTKWYHRYLGKEILRETPDNILEVQESGEYRCQAQGSPLSSPVHLDFSSASLILQAPLSVFEGDSVVLRCRAKAEVTLNNTIYKNDNVLAFLNKRTDFHIPHACLKDNGAYRCTGYKESCCPVSSNTVKIQVQEPFTRPVLRASSFQPISGNPVTLTCETQLSLERSDVPLRFRFFRDDQTLGLGWSLSPNFQITAMWSKDSGFYWCKAATMPHSVISDSPRSWIQVQIPASHPVLTLSPEKALNFEGTKVTLHCETQEDSLRTLYRFYHEGVPLRHKSVRCERGASISFSLTTENSGNYYCTADNGLGAKPSKAVSLSVTVPVSHPVLNLSSPEDLIFEGAKVTLHCEAQRGSLPILYQFHHEDAALERRSANSAGGVAISFSLTAEHSGNYYCTADNGFGPQRSKAVSLSITVPVSHPVLTLSSAEALTFEGATVTLHCEVQRGSPQILYQFYHEDMPLWSSSTPSVGRVSFSFSLTEGHSGNYYCTADNGFGPQRSEVVSLFVTVPVSRPILTLRVPRAQAVVGDLLELHCEAPRGSPPILYWFYHEDVTLGSSSAPSGGEASFNLSLTAEHSGNYSCEANNGLVAQHSDTISLSVIVPVSRPILTFRAPRAQAVVGDLLELHCEALRGSSPILYWFYHEDVTLGKISAPSGGGASFNLSLTTEHSGIYSCEADNGLEAQRSEMVTLKVAVPVSRPVLTLRAPGTHAAVGDLLELHCEALRGSPLILYRFFHEDVTLGNRSSPSGGASLNLSLTAEHSGNYSCEADNGLGAQRSETVTLYITGLTANRSGPFATGVAGGLLSIAGLAAGALLLYCWLSRKAGRKPASDPARSPSDSDSQEPTYHNVPAWEELQPVYTNANPRGENVVYSEVRIIQEKKKHAVASDPRHLRNKGSPIIYSEVKVASTPVSGSLFLASSAPHR

SEQ ID NO: 10463 - protein, 734 aa, Homo sapiens
MLLWLLLLILTPGREQSGVAPKAVLLLNPPWSTAFKGEKVALICSSISHSLAQGDTYWYHDEKLLKIKHDKIQITEPGNYQCKTRGSSLSDAVHVEFSPDWLILQALHPVFEGDNVILRCQGKDNKNTHQKVYYKDGKQLPNSYNLEKITVNSVSRDNSKYHCTAYRKFYILDIEVTSKPLNIQVQELFLHPVLRASSSTPIEGSPMTLTCETQLSPQRPDVQLQFSLFRDSQTLGLGWSRSPRLQIPAMWTEDSGSYWCEVETVTHSIKKRSLRSQIRVQRVPVSNVNLEIRPTGGQLIEGENMVLICSVAQGSGTVTFSWHKEGRVRSLGRKTQRSLLAELHVLTVKESDAGRYYCAADNVHSPILSTWIRVTVRIPVSHPVLTFRAPRAHTVVGDLLELHCESLRGSPPILYRFYHEDVTLGNSSAPSGGGASFNLSLTAEHSGNYSCDADNGLGAQHSHGVSLRVTVPVSRPVLTLRAPGAQAVVGDLLELHCESLRGSFPILYWFYHEDDTLGNISAHSGGGASFNLSLTTEHSGNYSCEADNGLGAQHSKVVTLNVTGTSRNRTGLTAAGITGLVLSILVLAAAAALLHYARARRKPGGLSATGTSSHSPSECQEPSSSRPSRIDPQEPTHSKPLAPMELEPMYSNVNPGDSNPIYSQIWSIQHTKENSANCPMMHQEHEELTVLYSELKKTHPDDSAGEASSRGRAHEEDDEENYENVPRVLLASDH

SEQ ID NO: 10464 - protein, 508 aa, Homo sapiens
MLLWSLLVIFDAVTEQADSLTLVAPSSVFEGDSIVLKCQGEQNWKIQKMAYHKDNKELSVFKKFSDFLIQSAVLSDSGNYFCSTKGQLFLWDKTSNIVKIKVQELFQRPVLTASSFQPIEGGPVSLKCETRLSPQRLDVQLQFCFFRENQVLGSGWSSSPELQISAVWSEDTGSYWCKAETVTHRIRKQSLQSQIHVQRIPISNVSLEIRAPGGQVTEGQKLILLCSVAGGTGNVTFSWYREATGTSMGKKTQRSLSAELEIPAVKESDAGKYYCRADNGHVPIQSKVVNIPVRIPVSRPVLTLRSPGAQAAVGDLLELHCEALRGSPPILYQFYHEDVTLGNSSAPSGGGASFNLSLTAEHSGNYSCEANNGLGAQCSEAVPVSISGPDGYRRDLMTAGVLWGLFGVLGFTGVALLLYALFHKISGESSATNEPRGASRPNPQEFTYSSPTPDMEELQPVYVNVGSVDVDVVYSQVWSMQQPESSANIRTLLENKDSQVIYSSVKKS

SEQ ID NO: 10465 - protein, 429 aa, Homo sapiens
MLPRLLLLICAPLCEPAELFLIASPSHPTEGSPVTLTCKMPFLQSSDAQFQFCFFRDTRALGPGWSSSPKLQIAAMWKEDTGSYWCEAQTMASKVLRSRRSQINVHRVPVADVSLETQPPGGQVMEGDRLVLICSVAMGTGDITFLWYKGAVGLNLQSKTQRSLTAEYEIPSVRESDAEQYYCVAENGYGPSPSGLVSITVRIPVSRPILMLRAPRAQAAVEDVLELHCEALRGSPPILYWFYHEDITLGSRSAPSGGGASFNLSLTEEHSGNYSCEANNGLGAQRSEAVTLNFTVPTGARSNHLTSGVIEGLLSTLGPATVALLFCYGLKRKIGRRSARDPLRSLPSPLPQEFTYLNSPTPGQLQPIYENVNVVSGDEVYSLAYYNQPEQESVAAETLGTHMEDKVSLDIYSRLRKANITDVDYEDAM

SEQ ID NO: 10466 - protein, 266 aa, Homo sapiens
  variant (1)...(266): Xaa = Any amino acid
DNVHSPILSTWIRVTVRIPVSHPVLTFRAPRAHTVVGDLLELHCESLRGSPPILYRFYHEDVTLGNSSAPSGGGASFNLSLTAEHSGNYSCDADNGLGAQHSHGVSLRVTVPVSRPVLTLRAPGAQAVVGDPLELHCESLRGSFPILYWFYHEDDTLGNISAHSGGGASFNLSLTTEHSGNYSCEADNGLGAQHSKVVTLNVTGTSRNRTGLTXAGITGLVXXIXVLXAAAALLHYARARRKPGGLSATGTSSHSPSECQEPSSSR

SEQ ID NO: 10467 - DNA, 1500 bp, Artificial Sequence
  Ra12-Ly1464 N-terminal fusion, plasmid construct pCRX2 insert
atgcatcaccatcaccatcacacggccgcgtccgataacttccagctgtcccagggtgggcagggattcgccattccgatcgggcaggcgatggcgatcgcgggccagatcaagcttcccaccgttcatatcgggcctaccgccttcctcggcttgggtgttgtcgacaacaacggcaacggcgcacgagtccaacgcgtggtcgggagcgctccggcggcaagtctcggcatctccaccggcgacgtgatcaccgcggtcgacggcgctccgatcaactcggccaccgcgatggcggacgcgcttaacgggcatcatcccggtgacgtcatctcggtgacctggcaaaccaagtcgggcggcacgcgtacagggaacgtgacattggccgagggacccccggccgaattctccatggacatgaagctgggctgtgtcctcatggcctgggccctctacctttcccttggtgtgctctgggtggcccagatgctactggctgccagttttgagacgctgcagtgtgagggacctgtctgcactgaggagagcagctgccacacggaggatgacttgactgatgcaagggaagctggcttccaggtcaaggcctacactttcagtgaacccttccacctgattgtgtcctatgactggctgatcctccaaggtccagccaagccagtttttgaaggggacctgctggttctgcgctgccaggcctggcaagactggccactgactcaggtgaccttctaccgagatggctcagctctgggtccccccgggcctaacagggaattctccatcaccgtggtacaaaaggcagacagcgggcactaccactgcagtggcatcttccagagccctggtcctgggatcccagaaacagcatctgttgtggctatcacagtccaagaactgtttccagcgccaattctcagagctgtaccctcagctgaaccccaagcaggaagccccatgaccctgagttgtcagacaaagttgcccctgcagaggtcagctgcccgcctcctcttctccttctacaaggatggaaggatagtgcaaagcagggggctctcctcagaattccagatccccacagcttcagaagatcactccgggtcatactggtgtgaggcagccactgaggacaaccaagtttggaaacagagcccccagctagagatcagagtgcagggtgcttccagctctgctgcacctcccacattgaatccagctcctcagaaatcagctgctccaggaactgctcctgaggaggcccctgggcctctgcctccgccgccaaccccatcttctgaggatccaggcttttcttctcctctggggatgccagatcctcatctgtatcaccagatgggccttcttctcaaacacatgcaggatgtgagagtcctcctcggtcacctgctcatggagttgagggaattatctggccaccggaagcctgggaccacaaaggctactgctgaatag

SEQ ID NO: 10468 - protein, 499 aa, Artificial Sequence [sequence omitted]

SEQ ID NO: 10469 - DNA, 1442 bp, Homo sapiens
gcgtgaggcaccgcggctggcctgagtttcttcttaatactgtatcacaattgtgggctgtcttatgtgttgatatcgattgagctatttgaaataggaatgttaatgggtgtattaaatttttgtaaggatataacaatatctaccttccaaggatgttgtgaggttttccatgattttgtatatgagctaatgttacctttgaggggtggtgtgcattatgttggatgattgtaaattttcagtggaaaatgtaccgtgtcctaaatttaaagacatgaaaaatatcccaagatcatactagatcataatagcaattcctttacaaatgaattatggaggtaactgatctctaacagtttccttcatgttgttttaatgcacaagggcagaggatctgctgacccttggaaccagcgtgagctaaccacgtgctatagacacttcatggtgtcgcacccagggaagtcaaagcgctttgctccctcactgtctgtgagtcctcagccattagtaccccaccccccgctgctccaaaacttgagttatttcaaatgtttctcactgttcatctctccactgaccccactccagaaagcctggagagagtcccaagatgccacccaccttccccaatccctcgccacagatctgtgtctatctcacactctgtaagtgccgctttgcttcttcctctcttgaaaagactgagaacacacattttaacatgttaggaaaatggggcagcctaaaaaatgactgatcccaccgccagtgactcatgtatactccaggctagcagacaaggccctttttggtgggcctgcttctgtgggttcacagaaaccaaattactgtgggttgcaaagaattagcaggtcatttacaaagcagacatcccttcacccagactgtggttttgcatgctcaggttctcagtctatgagctttggtgcaggatcattttggctactggaaaaaccatagcttattttaaatttctggttgccaaagccaccacacgtgtggtctgtggatgaccattgtctgcagaatgacgaggaaggaacagaatgtggtttggggctcagggtggccttcccactgggagggaaggcgggagggagcccttgccctgggttttgacacagcctgtgctcacagcctctcctctcatctgcatttctcagaaatgccctccctgcccagtggtgactttccctcgtcactcctatggagttctacctggagcccagccatgtgtggaactgtgaagtttactcctctgtaaagatggtttaaagaaagtcagcttctgaaatgtaacaatgctaacccttgctggaaccctgtaagaaatagccctgctgatagttttctaggtttatcatgtttgatttttacactgaaaaataaaaaaatcctggtatgtttgaaaaaaa

SEQ ID NO: 10470 - DNA, 1637 bp, Homo sapiens
acctcctgggctcaagcaacgagccatcctcccgtcttagcctcccaactagctgagactacaggcgtgggtcaccacacccagctaatttttgtactttttgtagagacagggtctcaccatgttgcccaggctggtcctgaactcctgggctcaagtaatctgcccacctcagcctcccaaagtgttggggttacaggcgtgaggcaccgcggctggcctgagtttcttcttaatactgtatcacaattgtgggctgtcttatgtgttgatatcgattgagctatttgaaataggaatgttaatgggtgtattaaatttttgtaaggatataacaatatctaccttccaaggatgttgtgaggttttccatgattttgtatatgagctaatgttacctttgaggggtggtgtgcattatgttggatgattgtaaattttcagtggaaaatgtaccgtgtcctaaatttaaagacatgaaaaatatcccaagatcatactagatcataatagcaattcctttacaaatgaattatggaggtaactgatctctaacagtttccttcatgttgttttaatgcacaagggcagaggatctgctgacccttggaaccagcgtgagctaaccacgtgctatagacacttcatggtgtcgcacccagggaagtcaaagcgctttgctccctcactgtctgtgagtcctcagccattagtaccccaccccccgctgctccaaaacttgagttatttcaaatgtttctcactgttcatctctccactgaccccactccagaaagcctggagagagtcccaagatgccacccaccttccccaatccctcgccacagatctgtgtctatctcacactctgtaagtgccgctttgcttcttcctctcttgaaaagactgagaacacacattttaacatgttaggaaaatggggcagcctaaaaaatgactgatcccaccgccagtgactcatgtatactccaggctagcagacaaggccctttttggtgggcctgcttctgtgggttcacagaaaccaaattactgtgggttgcaaagaattagcaggtcatttacaaagcagacatcccttcacccagactgtggttttgcatgctcaggttctcagtctatgagctttggtgcaggatcattttggctactggaaaaaccatagcttattttaaatttctggttgccaaagccaccacacgtgtggtctgtggatgaccattgtctgcagaatgacgaggaaggaacagaatgtggtttggggctcagggtggccttcccactgggagggaaggcgggagggagcccttgccctgggttttgacacagcctgtgctcacagcctctcctctcatctgcatttctcagaaatgccctccctgcccagtggtgactttccctcgtcactcctatggagttctacctggagcccagccatgtgtggaactgtgaagtttactcctctgtaaagatggtttaaagaaagtcagcttctgaaatgtaacaatgctaacccttgctggaaccctgtaagaaatagccctgctgatagttttctaggtttatcatgtttgatttttacactgaaaaataaaaaaatcctggtatgtttgaaa

SEQ ID NO: 10471 - protein, 98 aa, Homo sapiens
MHKGRGSADPWNQRELTTCYRHFMVSHPGKSKRFAPSLSVSPQPLVPHPPLLQNLSYFKCFSLFISPLTPLQKAWRESQDATHLPQSLATDLCLSHTL

SEQ ID NO: 10472 - protein, 59 aa, Homo sapiens
MFLTVHLSTDPTPESLERVPRCHPPSPIPRHRSVSISHSVSAALLLPLLKRLRTHILTC

SEQ ID NO: 10473 - protein, 84 aa, Homo sapiens
MTIVCRMTRKEQNVVWGSGWPSHWEGRREGALALGFDTACAHSLSSHLHFSEMPSLPSGDFPSSLLWSSTWSPAMCGTVKFTPL

SEQ ID NO: 10474 - protein, 66 aa, Homo sapiens [sequence omitted]

SEQ ID NO: 10475 - DNA, 51657 bp, Homo sapiens
  misc_feature (1)...(51657): n = g, a, c or t
gtcttctccctgtgtcttcacgtggtccccgctgtctgtgcgttgtgccctgatctcctcttcttataaggaccccaatcatattggattagagcccatccacaggacctaaatttttcccttaactcttttcctgtttgccccaagaacactcaccagcagctcttgcggctgcagcgtttaccccaaagtaatttggtcacaaaacatctcccttttattattttcactttgctttagtgtatcaactttggaaacaaaagacatcattctacgtataagacatcattctaggtatagcgttctgtctttagtagtggcatttccatttagaaaatatagtaattctcgatcgctgaaaatgtcaaatccgagaaaacatagcattcctatgtgatcattctcaaagagttgttggccaaagattcatttgattaatcctatttttctgaaatagacgattctgatgattgagatgattttgatgttagttctgtttacacataactccaagaacagtttttaaattttactttcacattgaaaatcagtcaggttggtttatgtaaaattaaatgagctctggccaagcacggtggctcatgcctataatcccagcactttgggaggctgaggtggacagatcacttgaggtcaggagtttgacaccagcctgggcagcatggcgaaaccccgtctctacaaaaaatacatatatattagccagatgtggtggtgcatgcctgtggtcccagcttctcaggaagctgaggcaggagaatcatttgaacttgaggggcagaggttgcagtgagccaagattgtgccatggaaccccaacctgggcaacagagcaagactctgtctcaaaaaaaaaaaaaaatgctggcagtgggctgcacttttttttttcctaaacaggaaaagggttaattatttctttaaagaacctagcaccaaatacagtcacattcggaggtactgggggttgggacttgaacatatgaattttggaggggcacaaggcatcccatgacacatgtgggaaccggtataatctctacagagactagaatttagatttaacagcttgaaacagcttcaagttattggtaacatacaaaacaaaaacaattcaaagccctttacattcaaattattgaataaaaaataactatttctacaatgtataaaaggtatgctatgtttattagtcttacttgtagctaatctacttttatgtttccttacagaaaattcttgacattttatgtttccgtgtaagagattgtacagaaggcaaatttttgtgttatgcaataataatactctaatacaaattctgttatgaacttcattggcactatatttaaatgtcatagcaattatttttatgtggtattttcaaataatctagatttcatgcagcattataaaactaactggggctggggacactggctcatgcctgtaatctcaacactttgggaggccaaggcgggcagactgcttaagcccaggagtttgagaccatcctgggcaacatggcaaaaccccgtctctacaaaaaatacaaaacaaaacaaaattagccagacatggtggtgcacgcctgtggtcccagctactcaggaggctgacacaggaggatcacttgaacacgggaggcagaggttgcagtgagccaggattgtgccactgcattccagctgggtgacacagcgagaccctgtctcaaaacaaaacaaaacaaaacaaaaacaaaacagaaaacagtgtgagaagtgttcattacccacccacccccacccccaaagctttccaagctcccgaccccatacagaggcaaaggatgcactgtgcaaagctgcctgcctggccccaaacgtccagtcaaacccaccactgcccttgcatgacttctgacccctccaccttcaatctagaccccacacctatcccaccatcatctcaagccaagggggaccttgaataaaggttttcttcctgtccctgcacctccagacaagagagtgcaatggtttcttagacagatcagatcctgttaaaacatttaacaaggtcaagataacttaaaatagttaccagacaaaaatagatggactagtacatggacagcagctaactgagacatgggatgctacgtttcttattcacacatcagatcttgacatcatattagtaaaggtgtggggcggggacatgccatggccagggtggggtcgcagctggccagactgagctggcccttctgttgagttgaaccttggggatatgcagccgctgtgcaatggtgccacctgatggtactttgtagaataaccactctcctagtttttcttcatctttaagttcctaaagagagactgaaatttcaaattggtttccttgttgtctattattgtcaaatgaaaagtgcaaacgttggtactcacctctcttgatttttatctgtctaaaaaatgaaatctcagctatattcactgatatattatggaaagaacactggacttaagggatttgggttcagatcccattttcggcaacttactagttataggatttggtaaagttactcaacatctgcatgcccattttatgatctggagaatggaaataataggattcttgtgaggattacaggaggtgatatatgcacatctgcgtccataaatcaagcctgggtgttgtggaggtgtgcgtcaccatcatgcattctctgaaggaggctcagccagctctacctttaatggctgggatttacttgtcttttggttcctttccacctgtttgccagcagaggctaaggttgtgatggaggccatctctcagcagatgagttgagaccatcctgggcaacatggtcaggaccacccttgggcctctgtgcagggcagtgcccaccctgatgcctacgctggtcagattgagagcatagacatggggccatgacctccataaacccccacccagtgccacatggcagcccaaggaaccctcttagccctgggttcttcgtctgtaaaacgaggctaacgtaacaaggggagctacttagtaaaccaaaaaaaaaaaaactaaactacaattcgtcttctgggatgttttgttttgttttgttttggagtgttatttggctgctgttttactctatattcccagagacaaatgaagcgtaagaggctgttcttgcattactataaaggaatacctgagactgggtaatttataagaaaagagaagttcttttgtttttggtttgttttgagacagagtttcactcttattgcccaggctggagtgcaatggtgagatcttgactcactgcaacctctgcctcccaggttcaagcaattctcctgcctcagcctcctgagtagctgggattacaggcatgggccaccatgcccggctaatttcgtatttttagtagagacagagtttctccatgttggtcagactggtctcaaactcccaacctcaggggatccgcctgccttggcctcccaaagtgctgggattacgggcatgagccaccgtgcctggctagaaaagaggtttaattggctcacagttctccaggctgtaaggaagcatggccccaacatctgctcatcttctgaggaggcctcaggaagcttatgatcatggcagaaggtgaagggggagcaggcacgccacatggcaaaagcaggaacaagagagacagctggtggtggggggtgccacagactcttcaatgaccaggtctcacaagaattcactcactatgatgaggacagcaccaagccatgagggatcggctcccatgatcccaacacctcccaccagatcccacctccatcactggggatcacaatgcaacctgagatttgggcgaggacaaatatccaaactatatcaagcatcttccttcccctttctcccttcccctcctgattctggggagaagaggctgctgtgtgtttctgaagggctgagtgttctcacccacccccaaccccccaagtaaagaactcttatgtttcaggcccatggggtgtggggagaggtggtcccagaggagcagggcgtgagattggcagctttagttgaagaggctgggatagataggggggcaggggtggtggtctcagcaaatggtgaggagtgagggggaagggtgtccaaggctgctcagggggtggagcatgaatacccagaggctgagcttcaactcatcagcactgctcccggggaccacagtgactgaagagtgaacctctgagcagtgctcagggcgtcctgaggcccggagagccagttctctgaatggtgcaagaccctgtcaggtccacaggaccccagaagccaggaagcacaacaaattggatttccgcccacgctgagtagatgggagctagaaaaccaaagaaggccaggtgtgttggctcacgcctgtaatcccagcacttcgggaggccgaggcgggcggatcacttgaagtcaggcatttgagaccagcctggccaacatggtgaaaccctgtctgtattaaaaatacaaaaattagctgggcatggtggcatgcacctgtaatcccaactacttgggtggctgaggcatgagaatctctgaacctgggaggcagagattgcagtgagctgagattgcaccactgcactccagcctgggcgacagagtgagactctgtcttacaaaaaaaaaaaaagaaaaaagaaacaaagaaacaaagaaaaagaaaatcaatggcccttgcgccagagtgtcttggagggagtccacactgacacgcccacggggggagctgctgaaagcattccccagtccagtgctgccccgtgagcaccgccacctgtttcccgctttcctggccaccgtacatacatttgttcatgtttatagactctgaatatagagaccccacacaagaagagaaaggctcagaaaaacaatgttatgacctgcttcctgaggcaccctgcctgcaggaagtgcttttcacagcaagaaattctgactccaggacccatatttttagcaggaacatggtcagtcaacacacatcctctaggcctgccctggaccagatgaccaggaggaagcagccgtgagtcacagggagaaagccggtggctctgacagggacgcctgctgctccgccggggaacagctttcccctggtttcagttagaaaggtcaggggacgcctgaccacacaaggctcacgggaactgtggagggcggcccctcaggccacaatcagcaggtgcccaccatggcttctctcctggcaggtgaggacttcagtttttctccatggcttggctcacctgttctcttattctcagagccataatcaccctcctcctgccccagcctggagctctctgagaccctccactatagtaaccagcacagcctagagagggtaaatcctccggtgcccccaacatcccaccttcatgttgcagcgaggcccaaaatgtcccagaagaaaaacaaactccatcgcacaccaaaaacccaccaaaaaacgtgaaatcaccttcataatttgggaagtataaacatagttctatttgttctgtaacgtatttttcatgatcaggaaatgaagacaaagaaaggctttgggaattgttttatggagaggacaccatcttccaggtcctgccagctcagggctcccatctttcagcccctccagagctgagcccggagggctggggccgccctctccctgctcctgagccacagaagcccaaggctggccctgaagacctaacagcctcaggcatttgcagcccccttggcctaaaagggctgttaagagaggtgcagacgtgggccctgcccattcaccctcagaggaggtcgcgacttccaccccagcaagagtacccctaggactgtggagtgcagaggacagcgaccgttgactaggtacctggtgcagggtcttgccctccctccctgtagcccgatatgggaagggccacagtccaagtccatgttcatgctgctcctccaggaggccttcccaaacatcttctcgatgccgagtaactcacagatcccatatagaaatagaccttggaagggatctctcttcttgcaaatgaagaaactgaagaccagagatgtacctcaaatcacacagcgagtaaccggcagagccaggaggctcctctgcccccaggccagagagggcttgcaatctggcttccgagcagtggttcccaactcccgggccattacaatcacctgggatccccaccagtggaatgactctctgggggtggtgcttggaaggctggtggtggtgaaagttcccctggtgattctcatgcagccagattggagaaccctttagattcaggcatggaggttccacctggttccagatcacatggccatttggtctcaagaaagtcacagccctcctgagtctcactggcaaattgctacgtaataacacgcatcttcttgataaggaaccgatataaggatccagaccctggacctcctcaggaaaacagagcacgcattataagatacaatcgaataggagaagtttttcataagcttggagggctatggttattggattcaaaagaatagttttctctcttgtcacataccaatttgaaaagtagtaatacccattctttaacagaagtgtatttggggccagttgcggtggctcacacctgtaacatcaatactttgggaggccaaggtgggtggatcacttgaggtcaggagtttgagaccagcctgtccatcacagtgaaactccgtctttactaaaaaaacaaaaattagctgggtgtggtggcgcatgcctgtagtcccagctactagggaggctgaggcaggagaatcacttaaacctgggaggtgggggttgcagtaagctgagatcgtgccactgcactccagcctcggcgacaggagggcaaccctgtctcaaaaaaaaaaaaaaaaaaaaaagcctatttggaatcagtcccctcccacggggacctctttcaggaggtcaggccacagcaccgtggcaggcatgtggtagcccctccataaatggctgagcgagtgcagttgaagtgggagtctggtgttctttgaatacatcctgctgcattggaagaagcctgtgcaggactagacagttggccttctgtggcaggctcttgcctccaggccagttgagtgagtgcagatgtcctgagagaccagcagtgcagccacaccccatgggactgtgaggcgctctcacagtgaagaccaagcgcaggtagcactggctttgtggttcggagaaaagtcgacactcatttccttggggaaaaaaagtatttatcaaaggaagtctttccctcttggcaaaaaaaacagagacaagtaatttcctccagcagtctgagctgggatttgggggcaaataaccattaaacagagacacctgagggtgcacagatggtcactgtggcaaaggtcggctgaagaataataggtaatagggagccactgtgggttcttgagtggaggaggggcatgataaagcagggctggagagcagagggagaacggtagagcagaatgtcacaaggtgctggggccctgactccctaagtgcaggaaactgctgagtcttgaggtcacttgagcctcctcctgcctctgtgatagctcccacctgccacccccacaggccacacggtccaaatgtctcatcaactgctagcatacgctaagcagaagaaagcgtgtggctgtcccattttttatgcaccaagccgtgaggccagaggcaccacccctctgcttggaggattctgagggtggtggtagttgtcatctttccagggaatgtgtggccttctagagcctaataatagtgataaccataactgccgcttatggaggacactcatgagacggtaccgagctcgaattcgaatacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacccaagggaaaaacagtgtgaagtccagttttcagcctgcccaatgaagcctgagctacagcaaccatggtaggatgaggaaccaatgtctgcccattggcaggagccatagatacaaacccaaccacttgctccaaaaagtgctgcagctgcggctttcacactgcactttgcattctcctttcagctctgttgcggaggtagccgctactaagcttactttaccagttactaatgtgccaaaaatggatccagccacattctccatgagcttcccacccccaggaagtacccctgttcagtagactccagaagcaaaagacacctgccagaatctgttctcttcctccacctcccacctcccctttgcatgatggatacctgcacccttctcgctcctggagtcggacatatccaaaatcggtcatttggggtacgggcctaatagaataagctttaatgtaaacccaagtaaagcatgtcttatgcctcctgtgccaatgaattgaggaggcatctacccaggcgaggctagccaggtgccccacagtaccccacgggccactgtgttcctcttgattagaaaagttcctaacttattgcaacccagggtttacatccccacctgactcaggccccttaaggcaggaaccttatcctgtttaccaacaactctgggtaatacatagcttttgctagtaacaggggctactaacagctgggcacagtggctcatgcctgtaatcggagcactttgggaggccgaggcaggtggatcacctgaggtcaggagttcgagaccagcctggccaacatggtgaaaccccatctctactaaaaatacaaaaataagcggggtatggtggcgcatgcctgtaattccagctactcaggaggctgaggcagggaggattgctttaacccgggaggcggaggttgcagtgagctgagatcacatcactgcactccagcctgggtgacagagcggagtctcaaataacaaaaacaaaaagacaccttagtgtgaatttaagatgaagcactatctcccccaaggatattggcttgagggatgcaggagggtgcatgaagagagaagtacagggggctgcaatcgggacacgggggacaccaggctgaaaacagtacgccttccctcctcggtaaaggtcagtcaaccctggtgctatttccatcccccaccccattccctttttttttcttttttccttttccattttcaggattttcatgtcataactggtttcttgataacagcaatgtcacatgcctgaaaaaagtaagcacttggtcattcagagaaaattacccaatttttggtttccccttgaactttgttttcctgctctgatgccaacctctcagccatgccaccgccctttagtgccgagatcagaagatgaaaagaaaggaaaagcataaaatcagttggatatttttaaaaggccaatggcatctcttagataaatgggtttcacggggaaagagagttaggaggccattaaatttctttaactctccctcacccatcagcacaagcaaattaaacaaagaaaaaaaggaagccaccagggcaataaattcttaacacaaaccaaaggccttttctagttgctgtatcccctttccctaaatgaaaaagtatctcactaaccctttcttcatatttttcttcacttactttcttctaatcactttaggatattagagctgctactccaaagtgagaaattgcaataaatgtgcttaggcccacatttacataaacttttctttttgggggggtagagtgtattattatattcacagtgtaactattgctgttcaggggtgacttttcagacaccatgaattcaacagcatcctcgaataagcatttttcttttcccaattgagacaagatttggaagttaacaaaccatttaataatatggcttcattttgttggcatggtctcactcactcacacacacacacacacaaaaaacagtaggaaaacactttccatatagtcttgctccccaaagggtgatgattcgggtcaggggacaccctgtaagacaatgcgctgcatgtaacctccatttcaagccaaagccaagacaatgaagacggctcccacagggtgcacacctccagcaagtgaatacagtagtagcagcagagcatggtcgtggaagttggggaaaagcgagaaaaccaagtgggcaaaattatgtcatttttgtatttttcaaaatgaatgttctttggacttacattagcagctagaaatgaatgtaaatgttctttcacttcagcaaggcattcttggaaggatgtcatcccactgttaataaaaatacaggcggggcacagtggctcatgcctgtaatcccagcactttgagaggccgaggtgggcagatcacctgaggtcaggagtttgagaacagcctggacaacatggcgaaaccctgtctctactaaaaatacaaaaaagtagccgagcatggtagcgggtgcctgtaatcccagctacttgggaggctgaggcaggagaatcatttgaaccagggaggccgaggctgccgtaagctgagattgcaccattgcactccagcctgggcaacaagagcaaaactctgtctcaaaaaaaaaaaaaaaaaaaaaaaaaaaaaaccacatagagggccaccccctaagaaaaacttaaaaccactgatttgtggtcaggtagcaacatcagggtggaaattttaatgcaaacatcatatttggggtacaaaagtaaattaaccaagatccccggagactatcacattactaaaaagggcagtgaaaacacattttcttgataaaatatatgacctaatttagccaatataagcatggttacattttccttagtcctacttctctatcatttttaagaccatgtgacaggtgtctcaggtgtcatctcagatgtgccatgttatacactgtgttctgtctgcagggcttcatcatacttccagaataagtttaatctacaaaaatggacttatgttaacacaaatatcaaccacaaaaccttaaggatgttgttagctttggctttttgaaggaaaattctccacatttatgcaactccattatctacgtgggggagtctccggagggtctccaaaagctgaccaaaccctaaagtattttttctccttttaatctgaaatcattcccgaatatgacaagtcaaattatcacttggttttccctgaataggacaaccctgtattataaccttgaccctgacaaggactgctcggttctaatgcctacactcccacctccttggcagaaagtgccctggcagtattgactgtaaacagagaggtagaaacaaagggatcttcagtaaaggcaccatctactgtctaaagttggaaagcaccaatcaacaggttcttcaggtggagaggtggattagggaagagctatgaggacctgagatgagttctagatcaggactgatcttgagccgtccgaagagtggctggtgggagcaactctcaaagcagaggttttcaaacttgcctgcacattagaatcacctgcggcgtcttaaaaattccattgtccaggctgcaacccaggcaagccgaatccagatctctgggagtgggacacaggcaccagtattttttaaaactctccagatgtggggccaagtttgagaaccaatgcccgcaaaagcattcccagcgagctttgagcaacgttttgagcggcataagcagagtcgggagggcagcggccttagggtgaagaacacacaaagcaaatatacaaagtttcaaaaatcctgtgtaactaactccaacatgacagccaagtacctgtctagaggccaaacagtgatgcaacttggaaaagtcccggggagagctagaatgtgtgctccgagtgaggcgggggctctctcggggatgacctccctgggcggcgcagtggtctggaggatcggggagagaaaggtcacacgcccctttctttccaggggatggtccggccgagcacgccgaggacttgtgtacgacaggataggtcagaaactgcttcgtgtgagtctctcccagctgtcactagagccggagggtccaggcaggggtgcgaaggcagaaagtccctcttcactaaagggaggttctgcagggcctcctccctcccaccccgccccgaagcgggttccccagggatcgcccgcatctgttctgcgcctgccctcggcggggcgcggcgcgggagtccgggtcgcatcttcgagccccaggacacgcgcggcgcgggtcaccgagagtggacgcgcggactgagcacagtgcacctggctgagcccgaacccctgggggtcccgccgccctgggcggcccctagcaccccgaaacccggctgccggcgcacaccccgccccgctccagcccggagctcactcaccgccgccgccgcctcctcccgcgtccagctcccgccgcagccagcagagcccggccggagtgcaagggccgcggcgccgccgggaggccgagcgagcccgcgccccgccccgcagtcgccgcccgccctcctgggaggaggggcaggggctggccgggggcctggacccgccggggctgccggcgggcccaaccctcccttcaatccgcccgcggcccgtcgggacgaacctacccaggaacccccgcaccacccgccctcggctccgctgggcccggggctgcgcttagacctcaccccttcccggagccgttcgtccttccacctcccctccgccgtcaccgggcatttttcttctcccagcctcggcctctccaaattcctggcctgcaggaagccctccctatttcgcgctctcgactgcgccgagctcagtttacccctttcccttcctttccctgcttagcctttttccccctcactgtcagaaacttaagggatagcgctcttctgccaccgcaaacccacacctatttattgagcacctactgtgtctagacactggtggggaggttatcccacttgcgcggtaacaagaaatgtctgtctctgttggagaaacagtaaagtgaggcgcctcgtaaggtcacacagctggcggtagtagggctgggattcgaatacagtttttaggtccttgtttagacccaccccacgataaactgcggcacgcctctcgctagctgtgagaacttgggcaaaatgttatcagttctaaaccccagttcactcatccgtaaaatgaaaagctggatacttcaccagctatgaggattccctgagaaaacaacaacctgtactttttttttttttttttttttttttggagatggagtcttgctgttttgcccaggctggagtgcagtagcgcgatctcggctcattgcctctgcctcccgggttcaagcgattctcgtgcctcagcctcccgagtagctgggactacaggtggccaccactacgcgcggctaatttttgtgtttttagtagagacggggtttcaccacgttggtcaggctggtctcgaactcctgaccttaagtaatctacccgcctcggcctcccaaagtgctgggattacagatgtgagccactgcgccctgcccaacctgtacttaatacatgtttgctgacatattgaatgaaatagacccttgaaaacttaacaattcaaaacaatataaaaggacttgaaaaagtaataggttggtgcaaaagtaattgcagttttgctattactttcaatgggaaaagccacagttacttttgctccgacctaataatagtgattcattgccaggaaagaaagaaaaaaaaaaaaagatgctacttatcccaagtgggcagcatggtcaagggagtctttttggaggaagcggtattgcactattccagagctagcaggtctaggttggggaagacagccaaggtgatggggtgtgtgaacagtgcccagagggtggaccagctttcctgagcagaggctgcctggggcaggacacacatgctagaaaatgggatgaggcatactagaaaggtggatggggtcagagggtggaaaaggcatcaaatgccaaagtgagggggctcaaggcaaccaaacagtacttggacacctcaaaatgactagaatggaacctgcatgcaatagagggcacctaaatggccctgggaaccagacgggggagacccatggcctaggaaccagcagagtcatggggtagatggggagttgcagcagggagggacaggaaagaaagaattttccaactgggtgcagtggcttatgcctgtaatcccaacactttgggaggccaaggcagtggatcacctgagcacaggaattcaagaccagcctgggcaacatggcgaaaactgtctctaccaaaaaaaaaaagaaaaagaaaaagaaaaaaagcgcatacacacacacacacacacacacacacacacacacacacacacacacacacacacacacaaattagccaggcatggtagcatgtgcctgtagttccagctactcaggaggctgaggtgggaggatcaactgatcctgggaggttgaggttgcagtgagctgtgactgccccagtggactccagcctgggcaacagaatgaaattgtctcaaaaaaaagaaagaaaagaaaagaaagagagaaaggagagagggagggagggagggagagaaggaaggaagggagggagggaaggaaggaaggaaggaactaatgaaggaaggaaggagagagagaaggggaagggaaggaaaagcagaaggtaaggaaaaggggaagggaagaaaaaggggaagggaaggaaaaagggaagggaagggaaggaaacggggaagggagggaaaaggaagggaaggaaaaagggaagggaagaaaaagagaaaggagggagggagggaaggcaggaaaaggggaagggaaggagaaggggaagggaagcacagggaaggaaaaggggaagggaagggaaaagggaaggtaagggaagggaaaagggaagggaagggctcttgtttggaagaccagatgtcttggtgaccagatgtgtgcaatgagggagtggaactggcaaaggcaaagctgaggcttccaggctgggtgccttggagcatcagaaataggaacaatatggaaagaggctgcttttcaggagagctcctgaaggttccatggagcatgaagtaatggtggaacttttcagtggaaatgccccagcaggcagctgggaagtggaggagtgtctctgggcagcatccatgtggagggtgaggggagagtgaggaccaggagccaggaaaggagagtgcagtgccttcactgagggtggaggaagcagagggcatcacccaagggagaaagaggagggtaactgagagctgttgggaagaacccaggagtctttgacggaagcccaagggtgagggactcctgaaggagagggcagtgccgaatgtcacgaatccacttctcacgtgggcccttccaaggatctgtagagagtgtgcactcaggaaatatttgttaactgtcaaaaaagcatttcatcagcaatttcccctcccatacagatattttgctgatgacaaaaataagaggagtcattggaggtaaagacagaggtgagagagatcagctaccagagatactgctttcgttgctcttattgtcaagatgaatgctcaagccccaccaacctcaacttaaagcaaacagttccagggaatgcttctgaaaaacatttttgtctttttttttatttaatgtaagtctggctcccttaattatggtttttgagccagtagaacgattaaggggaggaagagcggggtcagtgccagcaacttgccaaagagaagtttccaggaggatgagtagagaaaaatcacctcttttctcctccaaattttctgtacataaaatacgtgatacaaaaatattcacataagtgctacagtataaatgacatttgagtagtgacacagaatataggaagggtgacagaagggaggctgcagcatggaataggtcttatggcgtgcacttggaagacgtaatgcaaggccaggcgtggtggatcacacctgtaatcccagcactttggaaggccaagatgggtggatcacttgaggtcaggagtttgagattaccctggccaacatggtaaaaccctatctgtactaaaaatacaaaaaaattagccgggcgtggtggtgcacgcctgtaatcccagctactcgggaggcagagacaggagaatcacttgaacccaggaggcggaggttgcagtgagccaagatcacgtgatcgcactccagcctgagtgacagagtgagacttcatctcaaaaaaaaaaaaaaaaaagaaaagaaaaaagaaaaagaagaagatgtaatgcacatggataacagaaagagtgcggagggcatttctggaaggtgtggtcatacacccgagacagggaaacaggaggaagtgaacaaaacaaaaaataatacacggtttatttgattgaagtggaaaagctattccgcttgtgaagcaagatgggattgggaagggcacctgggaagagggcttttgcttggagtcattgggaaacaggctgccttaatacgggttgccctgaagggggagcctgtgacaagacttgcctgctggtggtgtatttagggtgatccctagaagcaggagagaggaagcaggaagagtgcgacaggcaaggaggaaaggccagtattagggtgtgttaatgagactggtgctatatgcagggggcctgattcccctgggacctcctgggaagatgctgaatgccccccagaattgacaacctgaagctcaggtagctggagtatttttccaagtctccagcaaagaccgctcctacatgccttacccctacttctaggctacccacctcccatgctgagagggctccttggaacaaaagtgctcacttgtgatggaaagctgtcagcacaaagttgatctgagcttccagggagctctcccagcacctatagcttctgcacctcccggctgctgcagtgcacatggtttcaagctctgcccctgctgtgccaggactccttcaggacctggtgcctacatcattccacagccagcagcctctcctggcactatccctctactccaagctgttgtgtggtggagcaactctaccaaaactctgcttccccataaacagctttccccagaaccccagaggtcagattaccagtaggttccatgggcatgacgccatagaaacttctttcccctccagtgagacccagctgtgtcctctccaacaaggtctggctctgagcaggagcagaggggagactaattccttgggtgctcaatctcatttttggactttgcacacttcccacatgaagtgaagaatctcagtcttaaactgttcacttttcaaagtgttcactcctacaagtgttgagggaagagacttaatacatcaaacaatcatattaagtttccgtttgaacttctagagccccttgggcaggcaaacttgctaggcctacggaaaaaagaatcaaaccccttggcaaggggtggcaagccctcaaaatctggccctgactggcagataagtcaatgagagggctatgcccctagccagccatccacactctgggccttctgcagctctattannnnnncnnngnnggggnnngggggggggcgggcgggccnngccccgcgggggcggcggcgggcgcggcggcgggcgcgcgggcccccgccccccgcgcggggcggggcggccgggggcgcccgcccgggcggggccggcccgcgngccggccccgccccgccggccccggccccgcggggggggcccccgggccgcggggccccggggcgggcggccccccgcgcgggggccccgcgcgncggggccccggggggccggcggcggggggccgcgggcgccccgcgggggggcggcggggcgcccgggggggcccgccgggccgggggccngggggggccccgcccgccgtccggcgcctttccccctttccccgcttcccgtttccccccttgttcccccttttccccgccccgccgtttcccgggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatgatacgaattcgatctcggtaccctcttagatgccagcccctccgtcttgcactttccagcctctagaattataagaaataaatttctgttattcttttttaattactcagtctcaggtattctgtcatagcatcagaatacacactaagatacctgcctaggccatgaggaccccaagacacagcacaaattttgtacaaactctaaccagaccacctttttcctactcccagggtgaggtccttccttcccctgtcccttgcagccctatgggcttttttgctttctctcattctccgggccttctgcagctctatttcctgcaagattgcatcttttctcctggatatttggtcgtcgctgggctgaggtggcagcctagtgttgggagcaggcttctggctggcctctgatcagtaagccagaggggtcaccttgtcctgaaatacaacccagccattggccatgttttccaccatcttatgagtattcccagtgaccaccctcagcagttcaagacaagttgggttacacaacaaggcagcacaataatgaagctcccacccctggcttgggcctgggcgttagaaagccctgcctgcggggggccctctcacatgcagaaggcaatgggtagtagcttcaccagacgatcctctgcctacctgctccaggtctccccctggggccatcccacctcttcctcattaaagcctgtgctgaaaggagcggggttgtttttcaaattctttcagcagtgagttattgatcaacactgatagtgcgagcagcttgatctcaccctgaactggcagagattaattagcttgattcccaagcataattcctaattaggcacaggaagaaaggaaagaaaacacaaaggaactattcttctccaggaaccaccgaccttctgtccaggggtggaggaggaagaaacaggtaagcatgtcccagcaccagagtgcttcctgcccattccaaagctgggcagccagcccgtcagcacaaacaacaccgaggacggtgccagtgccatcctgcaagggtctcagaagaaaatgtgcatttaatttgtttgctttactctctgcctaatgatgggcagggaaggcacaattaagcaggaggctttgaagtacctgctctaggcttgcttagccaccagaggctgaggatgcaagcaggggagagttcagctccaataggctggggaagaaaggttggatggggagggtgtagtggccctgagacttgagcagaaatagtgaaaggaaccacttcctgcagctgagaggcaggagccatcatgttctgttgtgggcattttctagaatgttccagccaggaccagcagctcaaatggctcttccctggtggtgggtagggcaataggagataggagggaccttcaatgtggcaactgtgaggtttggccaatcaacttacccatgctgagcttcggtttctcttcagtgaaatggggataattaatgatcgtatcagcttacatgacggttgtgagaattaactgaagaattcagagatgcatggcacataggaggcacttcctaacccacctaaagaaagcaaacccacagggcagcaaatcagaaatggatgagggctgacctcctctttattcagtagcacatgtctaatagacccgactgtgtctcgcacatgctgcccctgaggaagacttattatagggagctacaaacagtgtcacctgggaaagacagtgaactcagttatagaacaagaacacctgcccgggctgactgggggccaggatgcagggaaggctgcctggaggaagtgacatacccctgagtctcaattggccagggaaacaactgagcaatgatttgtgaaaatgagttcagtagaggttaataaaaattgggagtcctggccagtggctcacgcctgtaatcccagcacttcgggagcccaaggcaggcggatcacaaggtcaggagttcgagaccagcctgatcaacatgatgaaaccctgtctctactaaaaatacaaaaattagccaggcatggtggtgcctgcctgtaatcccagctactcaggaggctgaggcaggagaatcgcttgaacccaggaggcggaggttgcagtgagctgagatcatgccgctgcactccagcctgggcaacagagcaagactccgtctaaaaaaaaaaaaaaaaagggaatccctgctgtctgcagtaggccaatcaagtgtccaagaattgtgagaatgtgcttccccatcaccaccaccagcccacacccacaccaaaatgtgtcacccttcaatcccttcaagtctgtctgctcagcatcctgatccaaacaagccactttaaaaagtgcagttatgaaacaattcgaacactgactggactactgtttatatttttagatgtgatactgtggttatgtttctctaaaagtccttgtctgttagagatacacactgaagtgtttacagagagaatgatacaatcgctgtctggaatccgcttcaataccatccattgttggagggtgggtagtggggttagggggttttgaggaaacaagattggcccggtctatcagcattgatgctgggtgagataggtaaatgggggttcattatacactttacttttgaaaatgaagtttttcgtaataaaaagttgaaagaaagaaggaagggagatgggaaggcagggaaaggagaaagggaaggagagaaggaaaagattctgctcaaatgtccctttggaaaccttccttgacccccgcgttggtgtggggccgggggaatggggaggctgttttctgctcagccagagcaacaaggcccatgaggagacaggagggatgtctggggagcagtcccaagccacagagtccttctggggaccagccacaccatgagagagagcagaacagggagcatagcacagacctatgacatagcactgtgccatgacatcagctggcaaaggcccatgggaccaggagggaggcattagaagggcgaacactagcagctgttgagtaggaagaaatgtgagccgacttctctacctaaggaagcggtggcaaggccgtggaggttcgggatggggacgggttccaggattagagtgcttttttttttctttctttcttttgaaggaggagaggctatgggagcctcaggtaccgagcatctggtgtctggagagatgcagctactcaaggcagtttctgatctggaaccaggaagtctctgtttccccaccagccagcaaacgttctggacttggtgctgggcctgccaccaccaaaggtggagatgccccacatacctgcgtcaggcatgacaggtcacccctgagtccttgggtctccccaaggcttctccagggcttcccaacagggctgagattcaagaaaacgctcaaggtccaccccactgctccgaccctctcaccagaagaaaagggctgtgtcccaagggcagcctgcttgggaaaagaatatgtggggtgacttgtccagatctgcccagggaggctgggaatggagagagaaaggaatctgcccaccagttgggggaaaagtggatttcgcaacaaccttcatgatattaaatgcttggggggcctgggaagaccaaatgtttaatatttggagaagaggctgtctaaacagagtaattaggaggctcctttgtagtgatatgaaagagatgaattgggtatatttgacatcaaagacaggagatccagtggggaatgagacccacggccgggcgtgggcagcgctggaggacaggctctcccagtgtgctgcgggggagggcagcccctgcagtgtgcgtgttgagtgctgggaaacccccaagtaacacttcccccctcatttaacacacttcctaaaacctctcctccccaaaagccactttgcaaaagcagcgattaccaccaaccacgagaaacacaggagcctgccttccactgtttaccactgggcaggaagtcgtttatggaccagtctcttgcccaggctaaactcagaagtggacactgagggccggttgtgggtgccaccaggcaagctagggcatcggagttcagcagagctgggtgggaattctgcttctccctccactacctgggtaaccctgggcaagtcacttagcctctccgagcataaactggtttgcttgtaatatgcaaataataaggggtgggggaaattttttttttttttttttgagacagagtctcgctctgtcacccaggctggagtgcagtggcgtgatctcggctcattgcaacctccgcctcctgggttcaagcaattctcctgcctcagcctcctgagtagctgggattacaggcgcccgccaccactcccagctaatttttgtatttttagtagggacgaggtttcaccatgttggtcaggctggtctcaaactcctgacctcgtgatctgccctccttggccttccaaagtgctgggattacaggcgtgatggagatgatactccctaaatcacaagggtgtggtgtgaagatgaaatggctgcacgtgacagaggagttggagaacaggaagcaagtggattacttggatgaactgtgatgggcccaagaagaactaagccaatcactccagggggcgttttcccaggatccaggcagagagctgattccagcatccacgttgtatccccctcccgctgtggccggggtctccaagagccgggcacccactgcagagcttccaagcccaggcccatttgaacacaggaggacttttgaggttcatttaaccccaaaatcagtgattctacatctcaagctcatattttgaagtgtttacgggtaagtcatatgatactggtcatttattttttaaatattctagccaaaagtacatggtagacaaagtgagaatgtcagaatgttgataattagtgaaactagacgaagatacatgaaagtttaattttgattctcacctactttcatgtgcattaggaaactttcataataagttaaagtaacaaaataggccagactcggctgctcatgcctgcaatcccagcactttgggcggctaaggcaggcggattacttgaggtcacgagtttgaaaccagcctggccaacgtggtgaaaccccatctcccctagaaaataaaacaaaaaaaaaaaattgtagctgggcatggtggcaggcccctgtaatcccacctactcaggagggtgagggaggagaatcgcttgagcctcagaggcagaggttgcagtgagccaagattgcgccattgcactccagcctgggtgagagagcgagactccatctctgaataaataaagtaacaaaatacatttcagtctcgagctccagttccctgccaggaagagctgaagctgagctctggcaccccctgcttcttctccctcatccctaaaacatgtggggtactgggtgccaaaggagatctgaagatggccaccactcagaccagcagtagaggccaagaaggtggtgagaaattttaaggtattgtagcatatgctctccagggtgaggacacaggatgctgggacctaaggagggagaagttaacccagagagggcccaagtcagggaggacctgactgtggtgacagagccagtcatgctaataataggagcagtggttttgcaatcacaaatattggtctgggggactgcgggcccaatgtggtgggagttttagagcagggacccctccactgtacgtggattcttatacttgctaagttgcactgaattctcaatcaacccatttggaggctctcaccaagacaggagtccctttgaattggtaggatgttaaaagcttcctccagccattgaccctgggtcccattggtagaaatcagataataaatcagattttccaggtaatcctcagtttaatgtccattccctcattcaatcaattattcaattacaaatcatttttaatatgattttatggttcaggaattcaggcagggctcagatgggcagttcttctgccccacatggcattggctgataacaggctaccccaaggaaatcacagtgtaatgggagatgggaaataggttaacacaaagttactatactacaagaaaaatcttcaaatcttcaatcttcattcttcatgggtgtgagtcttctctggtggagaagagagttctttgctaaattatattcctgtgttagccagccaagcacacacggagtacagctgtcccttgctattcatggcagattgatcccagacactgccacccccagccctgtgaacaccaaaacccatggatgctcaagtccttgatataaaatggtatggtatttgcacataacctacacacatcttcccatatactttaaatcatcactagattacttataatacctaatgcaatgtaaatgctatgtaagtagttgctacgctgtattgcttagggaataatgacaagaaaaaaaggctgtacaacttcagtacaaatgctatcattcatttttttatctgaatattatgatccatgaatacagagggctggctgtaaaaagaatgtacagtttggtactttactcctagtttaagtcatctctttcggcccatacaggttgcctggggcagggcggtggtgagtgtgttgagtcggccctataccctgttccacaatgcctggtgtccttggcacgtagcttgcagggctgcttccatggatggctgcctcatcccccacccctccttcatggcaccctcttttctccaactccttttcctctgctgagtcctaccttttcttgccagaccagggatttgccaattattctggatgggcacagggaaggggccctcagatcctgcagagggagcatctgaaagacaatgagaccctgtacacaaccaagctgagcctcctgtaagcacatcctctgggtgtcactatgcgaaaagactctttgtctgtttacattgcacaacgaattgtccctctgattgtcctagcgttggtgcatgcatggatccaggaagagcaggtatttggacccaacgagacaggttcatcttggcagtttgtctcctgtggttgctttgtgcctgccccgtatctatccacccaacttctggcagcaatccctccaggacccacctctgtcttcatggtttgtgtgttctgatcctgctccttggccccagaatacaccctccacatctaagctatgcagtgcctcatccccacagctgcagcgattggtttaggaatgggaaaataatccaatcaaagtaagattgtctaatatctgatcccgcttaccccggagccagaagtcccacctttccaggctcctccatgttcctttctggagcaatgaggaggaaggttcattcccttctcagggaacttgctgcggtgtcccagtcctgactgtcccctctctacccctgcctgtggctctcccgtctcctggcattctaacctgccactgaattcttcccacgccaaacgcaggttaggaacctaagctcggatgaaatgctggcttagacctcattgctactgagaagcagaaaccacactttttagttggtagaggtggatgtggattggggccataaagtttcctcaatcattgaataaggatttcattatttggactaactaaatacattagattatttatactaactaaataaattagatttatttttcgaagtttaaaatcattttcaatagtgacgaaaaaggctgtagatgagatgggagaatctttcgacgccaaattcttcccatctcctgcctagtatgtatcactacaccttgcccagagagactgtaggggtgctcagcaaaaaccatggctggttgattccctggaaaaaggggtgctgtcccagggagctctgtgcccttcctgccaacactggggtctagaggaggcaagttcccctctgaaggtgagtatgattcactcattaaaactaagaaatttacattggtatgttactgttaactaacctacagactttttttagatttcaccgttctttacactctcgtcctttccaatttccgggatccaatgcaggataccaggttgcatttttggatgtgtccagtctgtgatcatttctcaatctttcctcattttctcatgacttttgacatttatttatttatttattgtgtgagactgagtctcactctgttgcctaggctggagtgcagtggccccatcctggctcactacaatctccacctcccgggttcaaatgattctcctgcctcagcctcccaagcagctgggattacaggcgcacaccaccacgcctggctaatttgtatttttagtagagatggggtttcaccatgttagccaggctggtctcaaactcctgacttcaggtgatctgcctgcctcggcctcccaaagtgctaggattacaggcgcaggccaccacgcccagcctgacttctgacattagagtacagggagggattctgtagaatgtccctcaatttgggtgtgtctggtgttttgccatgagactggggttatgcttctgggtgccacacagaggtgaaatgtccttctcatcacattattcgagaggtacatggtaccaatgggacttatcgctgctgatgttaaccttgatctcttggttcaggtggtgcctgccagctgtctccactgtggagttactatttttccttttccccattttattcatcagaagccagtcactaagcgaggtcaaactccaggacaggggaattaagtgccaccttctggagagggagcattcacatttattacttgggatccttctgtaaggaagagctgtttctcctctaaaaaactctttaatccttttaagcctcaatttcttaattgtgaaatggggctaatacctgtatccaaccaagggagtagttagaaggtaacatgataggtggaaagcacttaacataggcaaaatgttatgatcaggaatgatcgagagacccatccaactatctgaaggagtcacttaactctactgtactgcagcgctgtaaagtctgcatctttcactgggggtaaaggcccccagtccctgagacgggccagtttggagacaggctggttttttctctgttctcctgagagcccttcagatgagaagggaggtctggagacagaatgccaaaagcccattaaaggcacggccttgcatttcagagagggagcaggtctagagaagaaccagaggagctcagctgagatatggtgtatggattggattttggtagaagatgggaagaaccaaacacctgagaaaccactttgaagatcggggtcagagtaaggcctaacacatagttggctcccagtaattattggttgattgaacagctcaaagagcaactcgaccaagaacactggactgggagtccagttacttggatcttgcattcctgatttatttttattttatatgtattttttctatttttttgagacgaagtctcactcactctgtcgcccaggctggactacaatggcacgatctcggctcactgcaaactctgcctcccaggttcaagcgattctcctgcctcagcctctcgagtagctaggattacaggcatgcaccaccacgctggctaatttttgtatttttaggagagacggggttttgccatgttggccatgctggtgtccacctcctgacctcagttgatcttcctgcctcagccttccaaaatgttgggattacaggcgtgagccaccgtgcctggccgtgatttattttttttgtgtatgtttgtttttgtcaacttgctgtgtgaccttaagcaagttacttaacttctctgggcttcactttccatggatgaacattgtaaagaggctggagagagatgaggactaggtacaggctttagaggagagccaccgccccggacttctccctctgtcaccccgctttccatgaccctccttgcctgactttgtgactccttgcctcgctatcaaaacaagtgctgcaatctcagtgctttccaagagccctgcattgttagaaacttcccagcacgcagcaaaggctgctgcaatactcgctctgcctgcctttgccctgcgcttcctacttaccctccttttgtttctcccaaacatctgtccctgactatgctcatctcatgtttgtcctcagctgctgaaagggccacgtttgctttcattacaaataagaccaccgagtgggctcctggcgtgggggcgggagcagccgcgcgcagtcttcagaggcagccccccaggctgtctctggagggtgtgtctctgcttccctttccccgtgtttattttcagacgaagccaagtggcccggggggaccctccggactcccagccttcagagaggagggcagctcgggctttcgccgcagtgcttcctgcccgtcacgtgtgtgctcctagccggggtcgggggagctggtatcttggcccttctgggaggacgcgcacagcccgaggaggcagagccccagacgggaatgggcttttcagaggtggggtgcgggcgaggggacgatgcattatttttaatatttgatttatttttccaactggacttcttcccggggctctttctgggcccagctgcctttgtgatcccgcgccccggtcctcggcctctcacctccagcgccggggcgccccctgctgtcggaagcggctgtgaccgggcagaggtgctatctgggactctgggttctcagcccggggacagcgaaccgaggggcagatgatccatcagaaaagagccggcactgcccagccccgcgcccctgcccctgcctttttccgggagcgcgccgcgccgcacccgctacggccgcttgaccccatctttgagcccggccccaagctctgggaccgtcgtgcccctcatcaaggaagagccaaggaccccaaggagaaggtcaggagcggcggtgtggatgtcccttggctgcaggccccgccgcgcactcccttcagtccttcccttctctagggaccaggtagcatcagtgcctggatctcggccttgtgtgccctgctccctgccccacctactaagaaccaagtctggttcaccggctcccaagagctggaacccattctcagctagctgggggcccaggccaccccttccctccagacctgtgtgccttctgccctggctccagggccccccacaccgtgaccagggcgggatccctatggggctggccagtcggcaccgtgccaggcccacagtgccctgggcgtccatggaagtcgttctgtgtctttaaaatcagaaggaagacattaacctttaggctgaagaaaatgttttagtacacagcaataacttatttgtctttatccaacagccataaaatataactttaaatattctattgatagagaaaggagttcatgaaggcagaaatgcctggggcccacgaacatcccagtgtggccctggacgggacatcatgctgggcaacacagctaaaatgcgggtgaagaccagatttcttgcacatggcggtgacgggatgctccctagagagcttcaagtggattctttgctttttattttctctcttaataaaaatgtatgatgtttacattgtcagagaacaaacagaactgtggcttgtgtttcatgtcttacgaaatgggtcttgtgtacttttggctgttctttcatgttcttagcagttatagatttggcccctctggaatggaggggccatatatcagggggtttggggcaggggacacggccctctgttcaccctgccctccctgataggttgatttatctccctgcaatcccttattcgccttccgggctggtctccttcccagtccgagatctgcccccaaggctttgtttggcaccgccccacccctgccttccccagtagtctttctacagatcaccccttcccatgtgtcctcagcgcacccctgccttccccaatagtctttctacagatcaccccttcccatgtgtcctcagcgcacccctgccttccccagtagtctttctacagatcaccccttcccatgtgtcctcagcgcacccctgccttccccaatagtctttctacagatcaccccttcccatgtgtcctcaacgctggccttctcaggagttctagcacccgtctccactgctttagcctgctaagactgccataacaaaccaccacagcttgggggattcaaccacagaaatgtgtatgctcataattctggagaccagaagtctgagatcaaggtgtccacagtgctgatttcttctgaggcccgtctccttggtttgtcaagagcctcttctccctgtgtcttcacagggtcttccctctacgcctgtcagtgtcctgatctcctctcagtcacattgggttagggatcaccatatgaccttgtttaaccttactcgtgtctttaaagactctatctttttttttttttttttttttttttttttttgagacagggtctcactatgttgcctgggctggagtgcagtggcgccatctcagctcactgcaagcctctgcctctggggctcaagcaattgtcctgcctcagcctcccgagtagctgggattacaggcgtgcgccaccacccctggctaattttttgtatttttaggagagacggcgtttcaccatgttggccacgctggtcttgaactcctgacctcaagtgatccacccgcctcggcctcccaaagttcggagattacaggtgtgagccaccacgcccagccgtctccaaatacaatcacattgtgcattactacagttaggatttcaacatgtgaatttgagggggactcaaatcagtccatacacccaccaccacctccacttccattcacagaaatgattgccagaactacagaccttgagcttgtgtggggtgacaatccgacaagcaacagtgagacagagctgagagggctgcagaccaggatggtgggaccgaggttgctaacaaagcgctgctgagacctgcacagcatggaggtgctgctgggggagaggggtccccgtgagtggatctgcttggtctgcccttgcaaatagttcttgtcaacgggaaggacttagagccccttgatctacactcatggatacttttttgaactcaaggtttacagtagaaaccagcagcaccccatcccctagggctctctaacccactgtgtctctaccctgaccttacctacctttttttttttttttttttgtgagacagagtctcgctccatcgcccaggctggagtgcagtggtgcgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttccagaatgtcatctagttggaatcatacattccgtagccttttcagatgggcttatttcacttgacaataagtttcctccacgtcttgtcatggcttggtagctcctctttagtgctgaacaatatttcgttgcctgggtgtaccacagtttatatatccagtcacctacatcttggttgcacaaggacatctcggttgcttccaagtttcagcaatcatgaataaagttgctataaacattcatgggcgggtttttgcatggatataagtttttaacccatttgagtaaataccaaggagtgtgattgctggatgggatggtaggagtatgcttagttttgtgagatacttcccaactgtcttccacagtggctgcattctcatcagcaatgaatgagagctcctgttgcctcacatcctcaccagcactggatgttgttggtgttctggattttggctgttctcataggtgtgcagtggcattggtgttttaatttgcatttccctgtaacatatgatgtggagcatcttttcatgtttattttgcatctgtataacttctttggtgaggcgtctataaaggtctctggtccactgtaaaatcacgttgtctgttttctcattgttgagtttttgtttttgttttgagatggggtcttgctctgtcacccaggctggagtgcagtggcataatcacagctcgctgcagacttgacctcctgagctcaagctatcctcccacctcagcctctcaagtaactgggactacaggcatgcgccaccatgccttgctaattttttattttttgtagagatgaggtctccttctgttgcccgggctggattcttgagttgtaagttctctgtatattttggaactacggtgtatattactatactggtggacacatattagaaatgggtgcaaacccatagactacgcaacaccaagagtgaaccctaatgtaaactgagtgacagtggactctgagtgattataacgtgtcagtgtaggttcaccatttgcaacaaatgtaccgctctggtgggagtgttaataatgagggctgcgaagcatgcatgggctcagggaggatgtggggaatctccgtattttctgctcaattttactgcgaatttaaaactgctctaaaaaataaactgtattaaaacagaaaaaaataatttaggattaatcaacgtgtaagttcctggtcattgaagtcagaacctcacctcatttggaagcaggaaatcccttctgtactcaccgtgtgcatgggacacactgaccaaaagcccctgcccattggccttcctgggcctgaagtggcacttcatgcttgccctccacttgcctgtcgccacatgcatgccagggtggcctcagccctgccttaccctttgcaggcccaagtcagcggggtcatccccagaaaggacttggtgtcatttctggaacaagtcatttctgggggtgcccctgctgtcacttccctctgctccagggaaccctctcctaggccctgccagggtgtgggacttcttgctgaccccagtccttggctcatctccctctttcttctcccagggtcgttgaagagggagcctattccttccaagccttaaagccaccctccttggctttaagttacagccaacattctggcagtcgtaggatccaccagcagaagctatgttctcctgcttggtctatgggtgaatctccgcagggccctctgttccccactcggtccccactgtgaggccccgcctggcccctctaggttctctgcccccaactggtcctgcccacttctgctctctccttcccttctcctcaatcatcacgcccttgttctcaggcctcactgccccagcacttagcacagaggatcaggaacttccacagtgatcctaaatctccctgttctttttaaatttactttattttttagagcagtgttgggttcacagtagtttttgcttccgtcaaaaaatgcttgttgactcggaacctcttccttggaaatttcaactgcaaatctgagagctgctttagagaaccctctgtgggagagtgcctgccacctgttgctccagttttctgtacataatctatgatcctcctggcaatcccatgatgtgggcattgttattcctgcgttataatcgaggatgttcaggacagagcctatctaggtgggaagtggcatggccaggatatgccccttgggtgccctaggaccagctctgttcccatctctgagctccctctgcccatcgggtaaggtctggtcacttccatactgttttcaatctactctgtgccaggcagggggtcaatcactgagatttgtaaggtacatgggtggggctggaggttagaagagagttttcaaatcactttcagcctagtggggaaggcaggcccatcaccaaggcagtccaccaacaaggctagagggagctgtgcttagcctgagggaagagccccatttctgtggcattatgggtgacatttgaacaactaaccactcatttcattacccagggtcaaacttcgccccagggatattcattagtaagatgaagaggcttactgtttgctgtggtcctaatgtctgtgtcccccaaaattcgtatgttgaaatcttaaccctcaagtcgatgatattaggaggtagggttttggggagaagattgggccataaggagtgaagttccatgaatgggattaatgcccttatgaaacaggccccagagagaaccatcgtttcttttgccatgtgaggttacagtgagaagtcgctggctaggcgttgatggctcttgcctgtaatcccagcactttgggaggccaaggtgggaggatcacttgaggtcaggagttcgagaccatcctgggcaacatagggaaaccacgtctctacaaaaaacacaaaaattaggccaggcacaatggctcacgcctgtgatcccagcattttgggaggctgaggcaggcagatcacttgaggtcaggagttcaagaccagcctggccaacacagtgaaatcccaactccactaaaaatacaaaaactagctggatgtggtggtgcgcacttgtagtcccagctacctgggaggctgagacaggagaattgcttgaacctgggaagcggaggttgctgggagccgagatcgtgccactgcactccagcctggacaacagcatgagactccatctttaaaaaaaaattagcctggtgtggtggtgtgtgcctgtaggtccagctactcaagaggctgggaggattgcttgagcctaggagtttgaggttgcagtgaactatgaccgcaccactgcactccagcctgggcaacaaagaaagaccctgtctttaaaataaaataataataataataataataaaagaaaggccatttatgacccagaaatcaggcccttactagataccagatctaccagcaccttgatcttggacttcccagcctccagaactgtgagctgtacatttctattttttaaaagccaaccagtttatggtatttttgttatagcagcctgaatggacacagttaaacctgactccagaaagtaaagcaggcccctgtgaaggaaggaagagggaggaaggaggaaggaagaagggggagggaggaaggaagagggaaggagggagaagggcggtggcctcacacccccacatctcatccgcccctggtgggcagcctccccaagggattgattccttcctcagcaacagttgctcagagttgagcacaggaacttgcctttttccaagtagcagacacaggccgaggcacagagtggggctgaggaaatgtgccgtgaatggatggtgaacaggaagggacactgaagaaggaggcggtactgagagcagccatcttggagcttggaaacggagacgcatgtgaagccgtttgcacagtatttttcccttaaaatatgggtggggaacaaggggctgtcatttgtctttttctttgggatggtgagcagtgagcagggcacgccgcgaggagcaaactgcagcccaagcacacgcggtcagcacgcggagcacaggtggggagaagcggctgacggtggcgtggccccgcgtacctgggtgtggacgccccgccgccccgcaggggaaagctcctggagtctggggtctgctgccccgagctctgggtgtccaggtaggaaacaggtagagagtatccgggtttcctacccctccgccggggtggctgtgcctccccatcctcctgctcccctccttccctccctccgcaggggagggcaaacccaacccccaggtgagggtctgttctgcgggagtgggaaacagctggcacaggctcaggcggcaggtggtggccctgctcctgctgtgagagatggaagccaggaggcggcgggcgggccgtgctcaggagacccatgccccacccagcctgagactctgtcattcccttccactgggctccccatgagaagccccaaagcaaagtgggtgtggctggtcagggtgagtagggcaggccggaacggacccggacccagaacggaggagggtggtgtggaccaggtgggccgcggaaggcacctagcctaacaggagagggacaggcgcacccccagacggtgggaaagcgccctctgcctccagctgggctcggcccagaccctccacttcccagccccttgcttctctgtgccttggaggtttcagggtgggctggtgggtgggaggacatgtgagagttcctgtgtcaggagttgaagcccatcttggccacttgcctgccggggccctgtagaaacccctgaagctataaacaggtgctcgtcaaagttgattccaggggagggtggcaggagcagtggcgggtggtgtgggaagagaaggactgctctctagagagctgatggcaccaggccgtcaccaccgtggtgacagcacacacacatccacacacacatgcacacacgcacgcacacacgtgcacacacgacacacatgcacacacatgcaagcacacatgcacttgcacgcacacacgtacacgcgcacacgcatgcacgcacgcacacgcacatgcatgacacacatgcacacacacatgccccactcctctactgggaccagcacagcccctccgttcctgctcgcccggaaggagggcgcccagccaggtttcctccccatgaattgagcgccagagaccaacagtgacctgtggtggtttttccaattctcttcccattctgtcaaggacagaggagatgctttgtgatacaaggggaaaaaaaggaaggtggaaagggaagaaagggaagggagggaagtcccccccagagcagcctggggaggggtctgggaccaggcctaggcccaggcacttcctgaagagatcaggtgacggcctccccggcctgcagacctcaaggcggcccaggcctcctctgcgctccctacgcgttgctctggtgctgacatccctggctatgctctccatgtagatgttccttttagcctctgcctcaactgaaatctgaagatcaggccaatttcgtggtctctcagacgtcggtaaacaagaggccttggctcctcaggagaccgagagtctctcactgtacttccttctcttggctccaaggacatagaacggttgctatggggattccttcatttgtaaagtaagttttcagaaaaaataatgactcacaagtcctttaagcaggaacaaagtcaatccttggggacgatatgatctaatagggtttaaaagaggaactgtgacgggctgcagttggcgggcttttcttcttttcctctttgatcctcacgcgtggacgaaacccaccagtggctcaggtgccctggcaccaccatttgcttctttgtgacatctgaggacaggtgttaaaaataacttagaaatggctaactaaggcctgacacactggctcacatctgcaatcccagcactttgagaggctgaggtgggagaattacttgaacccaggagtttgagaccagcctgagtaacgtagtgaaaccttgtttccacaaataattaaaacaaaaaaactagccaggtgtggtggtgcatgcctgtagtcccagctactcgggaggttgaggctggaggatcacttgagcccaggcggttgaggctgcagtaagccatgattgtgccactgcactctagcctgggagacagaatgagatcttctcttagaaaaaaaaagaaagaaaaaaagaaaagaaaagaaaagaaaaggtatgtctagctaggctaacctggagagttactgtcagagtttccaaaagggtcttcatggccacttctgggcctcgctggctgggtgaagttattagtccaagagtgccacatggcctttgcacattcatctgtattatgcctggcgaggcagagggctttccctgcattgattctcctggaagcctggggttagcagtatagactggaaagtaaggtacacagagtggagggactgaaccaggtccccttatatgtgagtacatacagttacttaggccgggaagccaggtcttctaagcagctagggccaacagagcaggagccaggaggaatacttttatgaacaaacttattttccaacatcagaaaaaagaaagttggctgttgggagtgacaaggagaaagaatgatgaggagctcaaatcaggtggacacctgattgagatgatccttcttttgtttagaaaagagtaccacactggctgtcagctgtgtgaccttgagaaagtcactctctctctcaactttctcatctgccaggtaaaagggctgagcttgaatgagcttgggtcccttccagcaatgatgcttgtgtactgcacctgtgctaggaataccagtaaggggctctccatgctaaaatcagcgttccaggattccacgtggcccacagcaccaagcccagccttctcagctttgagctgaaggctccgggtaacctgatcccagcccaacggttctgtgttatctccctctcaccatttcctgtggattacttattgttctatcctcccagccgccagggccttgttcgcacctgctaccagcaaagaatacccctcctaccccagtgccctggcctgaagacgtcctgttagtctttcagctgtcaatgaagatggcccccttttcaagaacccttcctggaatcctgagtttgggggtcgtgatctttccaatcccgtatccacggtcactgccttcacctgaatgcgattgcaattcgctagcccttcaattcaacaaatattctggaatgattagcgtgtgctgtgacaatgacaaattccgatacgggaagacatgaattaaatgatcacgttcacccacgcgtgattagaaacagggaagggtaaagaaggaagagaaaacggcttcctgagagcttgcctggggtctggaaggatgaacacggagctgggggcatggaagggagctgttcccaggagagttgagtgggctgggctggcctcttgaggctgggagaggtagacggtgtgtcttgatcagaggagccatctgggaatcctttgagggtttaaaaaggggagtaacagatccaatttttatttcaggacaatcatgctggctgttagtgaagaatggcctggagcactgggtctccgccccagctgcctgggagaaactgtgttgaaggagccataccccctggcctcccctccagactccagacaaccccagtcagctggctgggagggaggcagaagagaaacaggggtgcacctggggctcctgcaggggtccagccaggagatgggggcaacttggacagggacggtgagagaggaatgggctcggggggcatttgggagatgaaaagggcaaggcttggccatgaattcccatgggatgaaagagaaggaattgtcaggattgagtcccaagtttctagctcatgcaaataaacaaacggggcatccgctgagctcaagagcatggggaaggggtgttggagactctcccggggacccctgcagacttctgtaacccctttgagttctcgcaggcagaggccacggtgggtggggagcaggccttggcagggtacccgccccccaccaggcaccctccatcctagtagcccttggggagacatactgtggccagaggaagggtacggagaggtagaggaagccaaccggtgttcccgggcagccaccatgtggtcaaaggaccaggcagcttgtttggaagcgtctctgaggcacaaagtgccaggacccagtgctccctgagccctcccagcaggaaaatgaaaactcagcaatgggctcccagggaggcgggactgggggtgccttccatttatgagaggcccgcagagcaattcctgccgcaggggtttctgatcagtcagaacatctgcccacgttgatgtcttccagccacctgatgcagtggcttgggcctgtgggttggggggagtgggatcttaggcctgttttttgggttaataaattttgtgaccttggatgacatgtcacttatctcacagatcctgggaagggcaggaggaggagtgagacctggcctgccctctccctagaggctcatcagctccctggagacagacacgccctgggtaaagaacagatcccactcagccaggcagagtttcctggaggaggaggagggagagaaagagggcaggaagaagaggggagggtgcagagggggagaaagaaaggaggggaggaggtgaagagaaaagggaggaggagaaaggaaaaggagaaaacctgttttctgtctttaactgtccttcccctcaactgggaccctgtgctcctcctcctcagtcagaactcccccctcaggtccccccacttcacgtccctccacacttcctgtccctcccccactcatgtccctctccccttatgtccctccccctattgtgtccctcctccccttgtgtccctcctccccttgtgtccctccccctctcaggtccctccccctcctcatgtccctccccatctcaggtccctcccctcctcatgtccctccccatcacaggtccctcccctcctcatgtccctccccatctcaggtccctccccgcctcgtgtcttcctccccctcaggtccctcccaacctcctatccctcctcagcttgtgttcccccaccgctgtgtccctcaccccctcatgtccctcccccctcaggtccctccccctctcaggtccctcctatcctcgtgtccctccctccctcaggtccctcccccactcaggttcctccctccctcctgtccctcccccgctcaggtccctcctcccctcacattcttctgtcttcatttacaggcaggagaaatttcaaagtgtgtttgtaccacaattactttaaaactctaaagttgacctttaacggtttgtggatgttttaattttacttttacgtgataacctgcaataactacacagatgcatgcatttttgtgcttatttgtaagtgctttctttaaaactgcttttttcttacatcctttcagttcctttccctatgcctggagcctgggtaccagctattgaaaactgcttttctccttgttcattcaaacatattcacacataaaggttgtcattcctttttgtcactatttgacaaaaattggatcataccgtatacaattctctgctatttgttttgctcacctaacaataaatacactgtgaaaaataccttcagatgagtagatatcaatcttgttcattcttttttttttttttttttgagacagggtctcactcccttgcccaggttggagtgcagtggttcagtcacagctcactgcagcctcgcctcccaggctcaatcgatcctttcacctcagcctctcgagtagatggaactacaggcatgcaccactgaacctggcgaattttcatatttttttgtagagatggggttttgacatgttgcctaggctggtcttaaattcctaagctcaagagatccgcctacttcagcctccgaaagtgctgggattacaggcctgggccaccttgccctgcctcttactcatttttttattccaggttgcagggttttatttcagcaacacagagacagtcaagcacagccatacagcaggggcatccacagctgcctcaggaggcggcagcgtggcctcttttgcagcttttctctcttccagcatcctctgcttgtgtttggcccggcacttcctggcagaatggtgggcccccaggtcctgatagcggtcctggtaagccttggccacctgggtgaatgctccacttccttggcccagttctacctgtagttgtcttcttcccactactgacaggtcttgagccgctcctggataatattgacgatttcttgatcgactttgtagtccctcctccactgcatttcggcttcatatatgcacagtgtttcacgtgtccatgtgaagacacgtgagaccaccaagcaggctttgtgtgagcaacaagcctgtttatttcacctgggcgcagggggctgagtcctaaaagaaagccagcaaagggtggtggattatcattagttcttacaggttttgggataggcggtggagtttggagcgatgttttgctggcaggggctggatctcacaaagtacattctcaagggtggggagagaattgcaaagaaccttcttcagggtgggggagattacaaagtacattgatcagttagggtggggcagaaacaaatcacaatggtggagtgtcatcagttaaggctattttcacttcttttgtggatctttagttgcttcaggccatctggatgtgtacgtgccagtcacaggggatatgatggctcagcttgggctcagaggcctgacacacaagatgttcttctccttgcgctcagtgatgcccagcacgcggcagtactgccggtggtagtagtaatacctgttctttgcgtgctgccactctataaactctcacgagggtcgccgatcggtccactaggaggtcgaaggccttcatcaggtagacgacggggttgggcagccaagtctgcgatgacagtgctggcatgtggcgcgggggcgcagggtacacatccttgtctcacctgtcccacatggcagcagtgagcgcggacttcgctcctggatgcgctgccctggcctccacctcggtcccggtccctactgattctttgtaatggttgtgtaatattacatggtgtggacttaataaaggacccctacgcagccaagagagtttttttccccaatgggaaaacagattttttttttttaatgtttgagattttagtgaattatttttacctggcaaggagctgaactacctgtactgttcagaagccaagttcagcagtcttgtatgtgggatgtctgtaaagattaagaaagggggcgggcgtggtggttcatgcctgtaatcccagcactttgggaggccgaggtgggtggatcacgaggtcaggagttcgagaccagcctggccaacaaagggaaacccccgtctctactaaaaatacaaaaactatccgtgcgaggtggtgggtgcctgtaatcccagctacttgggaggctgaggcaggagaattgcttgaacccgggaggtggaggctacagtaagcgaagatcgtgccactgcactccagcctggcgacaaagcaagagtctctctcaaaaaaaaaaaaaaaaaaaaaaaaaaagaataagaaatggactctgccccaaggagtctgtgctcttaccagggggcagagccacacgtggccatgagacagctgcccctggcagctgcacggaggagagcttgaccgagcatgcgggagggagggcttgaggctggcccgctgggaggggacagctctggcaggaatcctggaagggcaggtgtggagtcagacatgatctgatgttctgtgtggccaaggcagaaggccaggcaggaaaaacccggttactaagaagattggttgagcagccatctccctcccactgaccgccccccaggaatctgtataacttcagcttattttcagcctttagtttcccctcgttggaggttgagtgcctggtctcttgattttctaactgaagaagggatgaaagtctgagatttcaatcaaaagcttaagaaaataataatccttggttggcccaattctttcctgaaaatacctcacactaagagaaattgcctttaagccccttttcttttctttcatgctttaaatttctttcttaattaaaaagagttgtttacttgatgtgggctccaaagtgcttatttattttaacgtatcttgtttcttttttccttatcttcatgacttgataactctataactctctcttcttgtgtcttaaaatgccggtcgtgtctgtcactgacatgtgataaggaacttcataatcagcccttttctattctcacagaatagaagttgtgtcaataacaaatggaaatcactgagctccaaaattcagctgccctaacctggctgcttgtccctatcagagattttagaatgttttccccttcagatgaatttcagtttcactcaatcctaccagtgtttgatgacaacactcatggaaaactaatggtaaattaatgtctgccttccaaagtacgtggttcagttcactgtgtaaaaaaataatgataataatactaaaggcagccaaactgctgattggcagaattttttcccatcacttaaggcatttgagttgcagtacgcagtctgagaatccctcagagacacaccacccagggacttggatccttgatctcagaaagattgtgatcgaattaagtctgactcaacaaataaggtcgctgggaagaagtgctggcattaaatttaccgttaacgccagggtcaatttactaaacagtcatcgacgtgtggttccacaagacctctgggtaaattccagaaactgactgggaggaagatagcttgcgcatgaagtcactgaatcctggtcagtgtgactcttgatgatcatctctcagtacaccagaaagcatttccaaagacaggacgccacttggcgtggaaagcctttggaagctatggaaggtgacttcttaagttaagtctagaaacgggatggcaggaggacaagaaactgggactctggtgccgggagcctggagtcctcattccactacagatgttaactgggctcagctattcaggtcactcagtggttcatcttagagttgtttctagactagatatttattgccctgcattacaaagacgggaaagtaagagttctgtccatcagccagttgtcaggcgtaaatgacgtctttccctcgcttcctgcgccgcagtttgcttatctgtcagatggagacgctacttacttacttatctactcatcacctccaggactattcacatgaataagaagagaatatagatatgaatttggcatacagagggaaaagttccacacaaatagaaaacactagcggaaataatttctagattcttcctggtgaagcttttcaactacttccaaaacacatcattgctgagcctgtgcaaattcaaatggcacaacccgaagagtcagtggcatggcctcttctctggccagagccttgggggccatcagcctgcacctgcctgtttgttctgccattgcctcatgttctcttcctcagacaccggggaagccaggatcacagaggcacttgtcagcttccttctgaaacagccctcctcagcttctctgctgtgtctcccgggtcttctcacagaattcttggccgggaagccaccttccttaaaggaaatcaagtctcccgatttcctagagccagagtagcatagggggcagctgtggggcttggagccagacagagccttattaattatccatggatcttgctgagccttggtttctcatctgtaaaatgagggtaataaagctactttcctggtcatctatgagtttgaaataaaagaatatgggggccaggtgcagtggctcttgcctttaatcccagcactttgggaggctgaggcaggtggattacctgaggtcaggagttcaagaccaccctggccaacatagtgaaaccctgtctctactaaaaatacaaaaattagccaagtatggtggagggtgcctgtaatcccagctacacgggagactgagtcaggagaatcacttgaacacaggaggtggaggttgcagtgagctgagatggcgccactgcacttcaacctcattgacagagcaagactccatctcaaaatgaagacaaaaacaaagaagagtatgggtgaaagggcctggtgtgtcacgggagttgaatgtgtgtccttttcctttttcccctgttccttccctgtgcagctgcctaccaggcactgtctcctctctcctggggaggcgctgcattttttccctgcaaaggaggtccagaaagcagacccagcccaatgtctgtgcatctgcctggagaaggcctcctgaggagcacaccaacactctccccttccatgttggccttctctgcactattcaggttcttgcctctttggaattgtgtgtatgtggagggaacatctggaggtgtcacttaatttttcatgttacatctggacctgtcacatagccacaaccgtaactgtacatggagaatcatgtcgtgtgtgctgtggacaagccaagaggtggctttgtgtgctcttctgccacacagaagagctgggtgctgcccagcgcgggtgctgggtgaccccggaggaaagagtcattccgagggcctgaagaagggaggaatcggtggcttgtaaggtgcactcccacttcctgtggttttcacaggcgatgacatgaggactggagatgaaatgaagcaaaaccttctggggtcacttgagctatttcttttgagtccacgtctctgggatggcatggcctgtcagccacacccgtttctctcctgttggcagctccattctgcaggggagcaagtgtccagtcctgggagcactggcagcagggatgctcggaatgcccaacctgtcctggggcctgccttcgcctctgcccctcagctgccttgccatctctcttcctcctctttatttttgtctgtccctatggctgtcagtggggtcttgagtcacctatgtcatcatatcaggaacattgtgtgttccaaagtgtgcttggtggaacacttgttacttgaaacagtgctttgtaaaatggatcctggggctagcagctggagatgccgcatcctctatctccttctcgtggatttgcaattcagattctctctattaaccctgaagaatcccataataaatggtttaattttgcttagtagtttcgcccaaacgtttttgatcacggatcctttcgtatgaactcccaagaaacacttattagcagtgtttggtgaatcacactctgggtaaagcgggcatgaacaacatattattcgtaggaatgctgtgacgtcaaactcaccagtgaaaaatctggcatcagagggttatggaaaaatgcgtgtgctttttttttttaatacaaatatgacattggtgcagatcagacgttcccacccctctcaccacaaaaagaacctttttagtcctttcctcaagggattccatgttttaaaggcttttaactacctaacaaactacaatttattgaataataatttatttctttgagttttatttatcaaagacatccaacggccaattagggcttctgatcagtcgagataaccatagttgccacactgagttgatatgactccagcccaaagcaaataaacttaatgttttatttagtctgggaacgtcattgaggtaaatgtatggtttcctctgggctttttgatatcttgaaaatagcttgcagaccccccttgctgccttcatggagtgcaggataggtgggaagcaggaccatggatggaaatgcagaggacgcacagctgttaggagggcgggagggacggggggagggggtggtgactggggctacaccaggacactggatagtagagactaagtggccacagccactgtgaagactgggggtccatgggttggggtgtccagatcctggtgaacaagcaagaagccactagccaaaggcacattcatggtgcacccttaatgtgggcaaaacctgggcacagcaccttccctctgtacgctggctgcattgcacccacccttcccccagcacccagaagaggcccagggaggaggacagggcaaaggggagtgaggcaggcttctttgacgggatactttccccagacctccctgatgcatttttcaatcacgagctactatgaggtggatgtattgccatggccaccttcagtgtcagtagagcccctgggagattaaggcccctgaggattctgcggtcggcttgctcctcacctcgaaggagagacctctgcccagggagctcatccttgcttagcagaacctgtgccactgttcatatggaaaggatgaggcactagagccacattcaggctcatcaagcagttctgtctcagatgatggagagccatgcgctccctaaatagagggtttcctggtgcattggagatgggattcgacatcctgtaatccactttccacctgactttacagaagagctgttactcgaagtaagagagagggctcctccgcaggagaaaagtgctcaggccatgccctttgcagccccattcagcctccatgggctgggtcctaagcccctcctggacccccagttactctcacagccccagacccctgcttagcaatggccttgaactaaaacgcatgatcctactttttgcctcccctccctcattagtcaggacagcattttcccaaaagatacaatctgtgtctggcggaagcctacttgcaaaaataaattcttccctgaacattttccaggcccattttagaaataaatctgggtgatgccttttactcatttccaaagccaaacaacctgaaccccgaggccttgttctgcagtgtaaatgttacgaggaggagggaatcaggatcggctcctcagaagaacccatctccacctctagcagggaggctgagcagtccccacagctgtacccaccgcaaaccactgctgctcagatctggggacacaggtggatggagctcacagcctgggtcccaggacagcacagccgcacccatccctctcaccctgccaggctctcccgcagcagggagccttcctctggtttctgggtgcactgacggctgcagcagctacaatctccctgatacccattcattcattcactcactcactaaatatttctgctgagcgcctgttatgtgtcaggcaccgtgctaagagctagaaatacagcagtgagcaagtgcccacggggcctggcatatatggggcactctactcacagcacaatgaccaagtgcatgagctggaaggcaggaggaagggagaaaaggaagcgtctgtgcagtcagctccctctgcttttgtgtgcaccgtctcattgaatcttcccaaccgcattccgtgattagaaggtgtccccatccccatattcacagaaaaacagccaagttccaaaggaaaggggagaggtggattgatacagtttgtctgatttcagagctccgaactctctcatccacgcacactacaaaggcactcacaagctcacaaacacacagggacacatattcacccccacacatacctggactgtgcctccctcctccgggggtacccagtgattgagccatgcgttaacattctacttttctttctttttctttttttttagacagagtctcgctctgtcgcccaggctggagtacagtggtgcgatcttggctcactgcaacctctgcctcctgggctccagcgattctcctgtctcagcctcccgagtagttgagattacaggcatgtgccacctcacctggctaatttttgtattttttagaatagagacagggtttcaccatgttgatcaggctggtctcaaactcctgacctcaggtgatccgcccgcctcggcctcccaaagtgttgggattataggcgtaagccactgtgcccggccaacattctactttttttcatcataaccatgttctgagcacccgctccggctcctgtatgctcctgtctgggcccaggaacccagagcaacaggggagactgagtccctgcccttcagtcatgtgctgtctagaaggaagccactggctgtggctactaaacgtgtgaattgtggttaactctacattgacatgtgctgtgagtgtgaaatacacactgagtttctaagacttagtaagaagaaaagaatgcaaaatattccatactttaaccaggttgagtaccccttatctgaaatgcttcagaccagaagtgttttggatttcgcatttgttctgtttttggaatactatttgtgtatacataaatgagatatcttggggatgggacctaagtttaaacatgaaattcatatatgttttttatacaccgtatatacatagcctgaaggtaacttcatataaaattttaaataattttgttcatgaaacagaagttttggctgcatgttgactgtgacctggaacatgaggtcaggggtggaactctccttttgcggtgtcatgtcagcactcaaacgctttcggattctggagaatttcaaagctcagattttttaattcgggatgctcaacctgtcttgatcacatgttgaaattatacattttttggatatattgggttaaagaaaaagtatgtaaaagataattttccatgcttcttttaaaaaaatgtggtggctacttacctgtttgagcttgcaggagcgtattttaaaaacgtggctactaaaatatgtaaggtcacatatgaggctcacgtgtgtgctcacatgatattgcttagggacagtgtggctggagatggaaagacaaaccataagcaagcgtacgcatgcggaacaagggtgcctgcgagtgggggtacaggtcagggaggaagcagtacagggcgggtggatgccagcagtcaggatgggtggcctcacgggtggaggggaagccaggagagggaggagccgggagtgagcccagtatgagtcatttcttatcctgcgagggactggggcctgggtcctgaaggaaggaaggaaggagatccagggagctgtataggcgcctgcctttattctttccccgactgagtgaggggtcctggcgctgcaggggccctctggaggtcaccacctccatccagcctctcagtttcatagggtcagtgtctgccacggtcctgatctcgggttggcaaacggtcctcaggccctgccctcgcgggtgctcactccacaggtgcattaatccagtgcctgtgatagtccaagcctgctctaagcgctgcggaggtggtggtgaccaatcaaagtgcccactccagggcagctcacagcaagggtggggtggctggagacagacaacaggcaaaggaacaactacatgtgtcaggtgtggtcggtgaaaagaaacatcaagagggagcatggatgggtgggagctgtgttagagagaaggtgacatttcaggagggacctgaatgaattcagggatggagccatgatcacaccaaga

SEQ ID NO: 10476 - DNA, 3067 bp, Homo sapiens
ggcacgagcaatgggacttatcgctgctgatgttaaccttgatctcttggttcaggtggtgcctgccagctgtctccactgtggagttactatttttccttttccccattttattcatcagaagccagtcactaagcgaggtcaaactccaggacaggggaattaagtgccaccttctggagagggagcattcacatttattacttgggatccttctgtaaggaagagctgtttctcctctaaaaaactctttaatccttttaagcctcaatttcttaattgtgaaatggggctaatacctgtatccaaccaagggagtagttagaaggtaacatgataggtggaaagcacttaacataggcaaaatgttattatcaggaatgatcgagagacccatccaactatctgaaggagtcacttaactctactgtactgcagcgctgtaaagtctgcatctttcactgggggtaaaggcccccagtccctgagacgggccagtttggagacaggctggttttttctctgttctcctgagagcccttcagatgagaagggaggtctggagacagaatgccaaaagcccattaaaggcacggccttgcatttcagagagggagcaggtctagagaagaaccagaggagctcagctgagatatggtgtatggattggattttggtagaagatgggaagaaccaaacacctgagaaaccactttgaagatcggggtcagagtaaggcctaacacatagttggctcccagtaattattggttgattgaacagctcaaagagcaactcgaccaagaacactggactgggagtccagttacttggatcttgcattcctgatttatttttattttatatgtattttttctatttttttgagacgaagtctcactcactctgtcgcccaggctggactacaatggcacgatctcggctcactgcaaactctgcctcccaggttcaagcgattctcctgcctcagcctctcgagtagctaggattacaggcatgcaccaccacgctggctaatttttgtatttttagtagagacggggttttgccatgttggccatgctggtgtccacctcctgacctcagttgatcttcctgcctcagccttccaaaatgttgggattacaggcgtgagccaccgtgcctggccgtgatttattttttttgtgtatgtttgtttttgtcaacttgctgtgtgaccttaagcaagttacttaacttctctgggcttcactttccatggatgaacattgtaaagaggctggagagagatgaggactaggtacaggctttagaggagagccaccgccccggacttctccctctgtcaccccgctttccatgaccctccttgcctgactttgtgactccttgcctcgctatcaaaacaagtgctgcaatctcagtgctttccaagagccctgcattgttagaaacttcccagcacgcagcaaaggctgctgcaatactcgctctgcctgcctttgccctgcgcttcctacttaccctccttttgtttctcccaaacatctgtccctgactatgctcatctcatgtttgtcctcagctgctgaaagggccacgtttgttttcattacaaataagaccaccgagtgggctcctggcgtgggggcgggagcagccgcgcgcagtcttcagaggcagccccccaggctgtctctggagggtgtgtctctgcttccctttccccgtgtttattttcagacgaagccaagtggcccggggggaccctccggactcccagccttcagagaggagggcagctcgggctttcgccgcagtgcttcctgcccgtcacgtgtgtgctcctagccggggtcgggggagctggtatcttggcccttctgggaggacgcgcacagcccgaggaggcagagccccagacgggaatgggcttttcagaggtggggtgcgggcgaggggacgatgcattatttttaatatttgatttatttttccaactggacttcttcccggggctctttctgggcccagctgcctttgtgatcccgcgccccggtcctcggcctctcacctccagcgccggggcgccccctgctgtcggaagcggctgtgaccgggcagaggtgctatctgggactctgggttctcagcccggggacagcgaaccgaggggcagatgatccatcagaaaagagccggcactgcccagccccgcgcccctgcccctgcctttttccgggagcgcgccgcgccgcacccgctacggccgcttgaccccatctttgagcccggccccaagctctgggaccgtcgtgcccctcatcaaggaagagccaaggaccccaaggagaaggtcaggagcggcggtgtggatgtcccttggctgcaggccccgccgcgcactcccttcagtccttcccttctctagggaccaggtagcatcagtgcctggatctcggccttgtgtgccctgctccctgccccacctactaagaaccaagtctggttcaccggctcccaagagctggaacccattctcagctagctgggggcccaggccaccccttccctccagacctgtgtgccttctgccctggctccagggccccccacaccgtgaccagggcgggatccctatggggctggccagtcggcaccgtgccaggcccacagtgccctgggcgtccatggaagtcgttctgtgtctttaaaatcagaaggaagacattaacctttaggctgaagaaaatgttttagtacacagcaataacttatttgtctttatccaacagccataaaatataactttaaatattctattgatagagaaaggagttcatgaaggcagaaatgcctggggcccacgaacatcccagtgtggccctggacgggacatcatgctgggcaacacagctaaaatgcgggtgaagaccagatttcttgcacatggcggtgacgggatgctccctagagagcttcaagtggattctttgctttttattttctctcttaataaaaatgtatgatgtttacattgtcagagaaaaaaaaaaaaaaaaaa

SEQ ID NO: 10477 - DNA, 3105 bp, Homo sapiens
gcaatgggacttatcgctgctgatgttaaccttgatctcttggttcaggtggtgcctgccagctgtctccactgtggagttactattttyccttttccccatttwattcatcagaagccagtcactaagcgaggtcaaactccaggacaggggaattaagtgccaccttctggagagggagcattcacatttattacttgggatccttctgtaaggaagagctgtttctcctctaaaaaactctttaatccttttaagcctcaatttcttaattgtgaaatggggctaatacctgtatccaaccaagggagtagttagaaggtaacatgataggtggaaagcacttaacataggcaaaatgttatkatcaggaatgatcgagagacccatccaactatctgaaggagtcacttaactctactgtactgcagcgctgtaaagtctgcatctttcactgggggtaaaggcccccagtccctgagacgggccagtttggagacaggctggttttttctctgttctcctgagagcccttcagatgagaagggaggtctggagacagaatgccaaaagcccattaaaggcacggccttgcatttcagagagggagcaggtctagagaagaaccagaggagctcagctgagatatggtgtatggattggattttggtagaagatgggaagaaccaaacacctgagaaaccactttgaagatcggggtcagagtaaggcctaacacatagttggctcccagtaattattggttgattgaacagctcaaagagcaactcgaccaagaacactggactgggagtccagttacttggatcttgcattcctgatttatttttattttatatgtattttttctatttttttgagacgaagtytcactcactctgtcgcccaggctggactacaatggcacgatctcggctcactgcaaactctgcctcccaggttcaagcgattctcctgcctcagcctctcgagtagctaggattacaggcatgcaccaccacgctggctaatttttgtattttwagtagagacggggttttgccatgttggccatgctggtgtccacctcctgacctcagttgatcttcctgcctcagccttccaaaatgttgggattacaggcgtgagccaccgtgcctggccgtgatttattttttttgtgtatgtttgtttttgtcaacttgctgtgtgaccttaagcaagttacttaacttctctgggcttcactttccatggatgaacattgtaaagaggctggagagagatgaggactaggtacaggctttagaggagagccaccgccccggacttctccctctgtcaccccgctttccatgaccctccttgcctgactttgtgactccttgcctcgctatcaaaacaagtgctgcaatctcagtgctttccaagagccctgcattgttagaaacttcccagcacgcagcaaaggctgctgcaatactcgctctgcctgcctttgccctgcgcttcctacttaccctccttttgtttctcccaaacatctgtccctgactatgctcatctcatgtttgtcctcagctgctgaaagggccacgtttgytttcattacaaataagaccaccgagtgggctcctggcgtgggggcgggagcagccgcgcgcagtcttcagaggcagccccccaggctgtctctggagggtgtgtctctgcttccctttccccgtgtttattttcagacgaagccaagtggcccggggggaccctccggactcccagccttcagagaggagggcagctcgggctttcgccgcagtgcttcctgcccgtcacgtgtgtgctcctagccggggtcgggggagctggtatcttggcccttctgggaggacgcgcacagcccgaggaggcagagccccagacgggaatgggcttttcagaggtggggtgcgggcgaggggacgatgcattatttttaatatttgatttatttttccaactggacttcttcccggggctctttctgggcccagctgcctttgtgatcccgcgccccggtcctcggcctctcacctccagcgccggggcgccccctgctgtcggaagcggctgtgaccgggcagaggtgctatctgggactctgggttctcagcccggggacagcgaaccgaggggcagatgatccatcagaaaagagccggcactgcccagccccgcgcccctgcccctgcctttttccgggagcgcgccgcgccgcacccgctacggccgcttgaccccatctttgagcccggccccaagctctgggaccgtcgtgcccctcatcaaggaagagccaaggaccccaaggagaaggtcaggagcggcggtgtggatgtsccttggmtgcaggccccgccgcgcactcccttcagtccttcccttctctagggaccaggtagcatcagtgcctggatctcggccttgtgtgccctgctccctgccccacctactaagaaccaagtctggttcaccggctcccaagagctggaacccattctcagctagctgggggcccaggccaccccttccctccagacctgtgtgccttctgccctggctccagggccccccacaccgtgaccagggcgggatccctatggggctggccagtcggcaccgtgccaggcccacagtgccctgggcgtccatggaagtcgttctgtgtctttaaaatcagaaggaagacattaacctttaggctgaagaaaatgttttagtacacagcaataacttatttgtctttatccaacagccataaaatataactttaaatattctattgatagagaaaggagttcatgaaggcagaaatgcctggggcccacgaacatcccagtgtggccctggacgggacatcatgctgggcaacacagctaaaatgcgggtgaagaccagatttcttgcacatggcggtgacgggatgctccctagagagcttcaagtggattctttgctttttattttctctcttaataaaaatgtatgatgtttacattgtcagagaaaaaaaaaaaaaaaaaactcgtagggggggcccgtacccaatcgcctgtgatgatggtatac

SEQ ID NO: 10478 - DNA, 1561 bp, Homo sapiens
cttaaagaggtaatttagccatcattcttatgccagcagatataaataaacttggacccatctggtcttcagctaaacctgagacattttaaagtgcatggacagccatggacagcaggccctcctctaacaggggatgcaaggcatggagaaagacaatcagtacccaagctcagccacagaagacaggagtcactcatataacttgtgtttagaagtttttggtagccacgcacactttctgaaatcacactatctggtggtttaatcatatttttaaagacagaatccctgagtgctgagcagattctcaaaacacatttagaatccctgaaattagaaagatcaatgacaaaatatctgtcagccaggccacaaacaggtgtaaaattatgaaaggagtggttggatgtgccaagtttggtaaagtggtgactgcatctgagaaagaggctgtgaggctgaactcttggtggcttccttctgtaacttccagagggagtcttcaacacaggccccgtgctcgtaggaatacggtagcacctatgtaggaagtgcgtggagttttctgtcttctttctgtgtgatttttggcctttttatcagcacttctcccctcccagsagcctggggatgccaaacatccagaatgtgatgggacaagatgggggcaggggcctcacctccctgcagaggtccggccaggtctccttgtccctggacaatctcctgagcctctctgcttggtggagcaggcacctgtgtgcagaattcccactgtggccagcacgaggaagtcttttctagtgaaaatgtgtcttgtggtcaggaataattatcctttcccctgtagccaccaaggagggcaaatagagaaaggtaacctaattgaaggattggtcatgtgaaaagggctacatttgggaagctgggaaaggcctccaggcttctagagcagctagcttgggctggattctcayacccaggctgccccttggattgttctacccaagcttttccctggggtctgggctcactccataaggtaaggtgccttttaccttatggtccttctttagcaggtaacaaaggagcatcaggggcaggctgccctggtggcatcacactggctagtgaggccgtgaatatcttgtcccccagcagggccgacagtttctatcacagaaaacagtgtgttcagtggtgaaaatcgttgcatgcatgttttcatctgagcgtgtccttctcccatactccctatcagccagccctgcctgtagctgctgtatggtgattgcacttggacatcagtccaatgactgcaagtcggcctggattttcacttgcagaggctacagctgcattgtcaggtctcccagccctgcagagagctccctccactggttagcagtgtgttgtgttttccattcatttcagaagagctacattgtgtcactggacatttttaaaaactgtgatttttaataaaaatttaaaatttgaaaaaaaaaaaaaaaaacctcgggggtaacttttrggggggccggggcccwtgcgtttt

SEQ ID NO: 10479 - DNA, 10620 bp, Homo sapiens
tgtatgtatgtgtgtggtgtgtgaaggtgtatgtggtatgtgtttggtatgtgtatatgtgtactgtgtggtgcatgcatgttctgtgtatttgtgtgcatgtgtatgtatgtgtgcccgtctctgcatatgtgtatgtatatgtgtgcatgtgggtacaggtgtatgtacatgcatgcacatgtgtgcacatgtgtgaatgcatgtgtacatttgtgcatgtgcttatgtgtgtggatgcatgtgttcatgtaaatgcatgcatttgtgcccatgcacatgtgtatgtacatgtgtgcatatacatgtatgcactgacatatatgcatgtgtgcatatgtacacgtgtgcatgccttctgtgcatgtgtgaatgcatgtgtgcatgtggatgtatatgtgtgcatgtctgcgcatgtgtgtaacctccttagaacaggcagaaattggggctctggaatcctttctttgcctaccgcagttccttttaggctgtcttcatagagaaagggatagctcaaaacccacagccctgctttggcctgatgggggatttctgggtctcctcagtctgtcttttattaggcaggccatgggctgtcaggccctggctgggtagatgctctgctcatgaataaaagatagaggcagggcaggacagggccctccctgatgggcctccccgccgttctgtgtggtggaatctcacagtcaactttgacctgtgcacatccacttttttttttgagataggatcttgctctgtcacccagctgggagtgcagtggtgccatcacagctcatttcagcctcgacctcccaggctcaagcaatcttcctgccccagcctcccaagtagctgggactacaggtgcataccaccacacccggctaatgttttgatttctgcagagctaaagtcttactatgttgtccaggctggtctcaaactctgggctcaagagatcctcctgccttgggctcccaaactgctgggattacaggcatgagccactgcacccggccaacacattcacttttttgggacatggcagggacttaatgttttagaaaacatttagctacccctttgacaatgctgcttgacactatttgacagtgtgacttaccacatcctaataacttccatgaaaatcatcacaaagcaaattttaaatttttattaaaaatcacagtttttaaaaatgtccagtgacacaatgtagctcttctgaaatgaatggaaaacacaacacactgctaaccagtggagggagctctctgcagggctgggagacctgacaatgcagctgtagcctctgcaagtgaaaatccaggccgacttgcagtcattggactgatgtccaagtgcaatcaccatacagcagctacaggcagggctggctgatagggagtatgggagaaggacacgctcagatgaaaacatgcatgcaacgattttcaccactgaacacactgttttctgtgatagaaactgtcggccctgctgggggacaagatattcacggcctcactagccagtgtgatgccaccagggcagcctgcccctgatgctcctttgttacctgctaaagaaggaccataaggtaaaaggcaccttaccttatggagtgagcccagaccccagggaaaagcttgggtagaacaatccaaggggcagcctgggtatgagaatccagcccaagctagctgctctagaagcctggaggcctttcccagcttcccaaatgtagcccttttcacatgaccaatccttcaattaggttacctttctctatttgccctccttggtggctacaggggaaaggataattattcctgaccacaagacacattttcactagaaaagacttcctcgtgctggccacagtgggaattctgcacacaggtgcctgctccaccaagcagagaggctcaggagattgtccagggacaaggagacctggccggacctctgcagggaggtgaggcccctgcccccatcttgtcccatcacattctggatgtttggcatccccaggctcctgggaggggagaagtgctgataaaaaggccaaaaatcacacagaaagaagacagaaaactccacgcacttcctacataggtgctaccgtattcctacgagcacggggcctgtgttgaagactccctctggaagttacagaaggaagccaccaagagttcagcctcacagcctctttctcagatgcagtcaccactttaccaaacttggcacatccaaccactcctttcataattttacacctgtttgtggcctggctgacagatattttgtcattgatctttctaatttcagggattctaaatgtgttttgagaatctgctcagcactcagggattctgtctttaaaaatatgattaaaccaccagatagtgtgatttcagaaagtgtgcgtggctaccaaaaacttctaaacacaagttatatgagtgactcctgtcttctgtggctgagcttgggtactgattgtctttctccatgccttgcatcccctgttagaggagggcctgctgtccatggctgtccatgcactttaaaatgtctcaggtttagctgaagaccagatgggtccaagtttatttatatctgctggcataagaatgatggctaaattacctctttaagttgtttttttgtttgtttgttttgacagagtctcgctgtgatgcccaagctggagtgcagtggcatgatcttggctcactgcgacctccgtttcctgggttcaagcgattctcctgcctcagcctcccgagtagctgggactacagacacatgccaccatgcccggctaatttttgtatttttagtagagatggggttttaccatattggccaggctagtctcaaactccttacctcaagtgatccacccgcctcggcctcctaaagtgctgagatgtctctttaactttcaagaggtacagcaaaactgaaatcaatgggtgatgacttcttaaagatcaaacatgaagatgaggattagttaagaccagaaaatcattctccgatcttgtatcttcaactcaaattcacactccaaaaggcctgtttgtggtgaggctcagggtctttggcttgttctgaattaatactttctttggaaactctttagatggctttgatccctgtgctgccccccattgcagacacagaaagcgacaggggattctggcggcaccctctctgtggaggagaggaaggtgtggaccacgttcagaggaaggcagcctgaagctgtcctcagtgagatgctgggggatgggcctcttgcccctgctgtgcagcctccatgcagggctttatttaccagtcaccaggtcttcaagacagtctgcaggagagaggatttcagggggaaagtaagccaagccaattcattctcatggtccccttttatcacaaacatgtaagtcttccatctcataacagagacagcaaaagcagtatccaggccttttttttttttctttctttctttccttaactggctacatgcttagaaactgcactggtcaaacttgattttctttttaaagcctcaaaacatttttattgtcaggaaagcttttcagtggccagggatcagtctcatggccgtagaagcagccaaattcctctgcctttgccttcccttcaggagtcacatgctaaggcatccttgggcatttggaaaaggccgcttggggtgagagtgctctaggccactctgcaatgtccctgggcccgatgagtaacaaatgcaccccgggacccagagaagtggaaagacatgaaagggatttggaaacagatcgtaaaaataacctgtatgaaaatcacacagacaagaaaacaaacaaatccagctagccccttggatcctgccatccgtcttttctcccgggactgcctttgctttgtggagggtgagtcctgggacaggctttgggtgacaagttgtgggcatgttccatccaagcctggctctcccgactggcagagggaggtggctgacaatcaattcctctggatacattttcctgtgattgctcctgtgatcaaaggcagccaccgacaggtgcgggagcggttagttcaccacgtcatagtagtaattgcgcagccgcagttccactgctgcgaatccgggcctgttttccacactggaatggaagagatgcattcttgtttgtcaatgtgcttgtgaaaaattgctgatcacaagcagggcctctgcaggctgagtaccagtggtgctgctccctggtggctaactctagggcctgcagctcacagcgtggtccctgtgccccccaccccagggtgaccacaaggctgtcaaaaatagtgtcggcctactgtagacctaaataacccatatctgcactttaacaagacctcccggtgattcatgtccaccctaaagtaggagactttttgcattagaactgggagtgttttagccccaggttcagatatgcggcacacaatatgcttctgtgccacaggcaacacgaagaggctgtcactctgtgattttagcaaaacaggtgtctgaaaatacttggcaaatgttctgcagatatagtcaacatctgactcataatcttgttaagagaagaaatacgaacataactttaattctccctttccacgctctaatcgatggctctggattttctgaaaatgggctgttgatatgggttcttaggaaagctcaaaacatgtcatggcaggagcaaagacccagggcttgtctatgatccaccttaatatagccagtccttactgccactgctggccagggaggcactaatgtcagtaaactatgggcaaaagcattaacagttcgcagtctctaaacaaacacttacagacacttctgttttgtcttacacagacatcctgtacagatcagttggaagtaagtactaaaaccctgataatcgatcctcacttagaagttatttttcttattttgcaagatttctggatatattgcaagtgggtgaagttgaaatacaataagtgaaaaagtgaaacagaatgtgaggttaaattgtaggaaaccgtccacattcagccattttgacctatatcaatggcaatttcatatgattcaatgtcgacacaagagaacagccatagaacgcgcatcaggaccaagactcactcatcattataagagcagagtggcttctacaaatcaaaatgggtagctttgtcaaatggcatcaaaatacatggtttctcttatagctttcaatagtgagcaaaatgataaaactgctcgaattgatcagtgtggtcagccatctgtggtcatgtctggggacacgggcctcccagggtgtcactgagaggggctttgtctctggccaccaagtgtgttccgagaggggatatggtggccaagcctctggtacaggagcatgtgtccacccagagggacagcctctgtcttgctcctaaacttctacagtcaaagagaacacacttcagcatctttgcaaaacagggggctctgctccaactgtggggatccaaatggtacaaagagcacctttggatcttgctctgggggttcatctgcccagcagccaaggagcaaacaaatgcagggaaacaggaatacagactcgtcctcaggaaaaacacctggtcaggtctcctaggaaatctctcctgtacatccatgggagatgctgcctccaggaagctgggacacagctgtgcttcagcagcaggagggtgatgcagtgcccttgcgtgcccagcttcctggcctgccctggcctgccactctgctttcgggccagagtgcagattctgctctgctccttgtacccagtgaccctcctcctctcccctcatccctgcactcaaccttgcttcttagcctgcaggtctcagctgcaatccctaaaggcggcctatctggagcccctgctggaagtgtgaggcttccctccccataattttctgttctcttttaaagtttccagtgtgtgattttatataaagagatatatggtctttatcctgggttcctggcacagagctcctaaaacccttggaatttcctgattgttgggctgaaagcagcatcttttgttactcataataaacccccttcaaccatacctgggtttgtgctaatgagactatttctctccctccctccctccttctctcccttcatctacctccctcccgctctctctgtctgtctctatatatcaccttggagagagtggctgtttactactgaggaaaaaatgaaaaaacaaagcaaaacaaaacaaaacagagaatatactaggaccacctgtagtcccttcattgaatccaccacattctagaagctccaatgtgcttctgtgctgcaggcaactgtgagaaactacttcgacacgagagggcttaaaaaaccccatatatacacgtgatatcctccaggcccctgtgccctccttgcttagaattcccactggagtcatccctttcctaagacacatcataggacacacttatttttagcttattgtttattgcctgtctgccccagccccaactataaggtctgatagggacagggtctgaggcttctgtgaggcttgcacctggggtggcagcctgcatagcaggagctccggcagtggccaccgaccctgtgaatgacccagggctctcagaggatgtgccgctcagaggaaagccttggagctgaggttgtgcagggagccaggggacatctcaccaaggtcctgggaattcatgttttatcttgggcttgttgatctttaaacaggaatttgagccgcatctagagcctccctgactctcagagaacctggagagcccaggaaatttctccattcggcagaggcccccactggagggctgggactattaggaaaccgtttttcaggatcaagagcaccaacttctctccatttgcaagggctttccccactggtgtctttaatcaccccaagcatgacttggctctggaaaacactacagtggaaggcttcctgactgattcctgcttttcttagggccagtgtttccttcctggctttcacgctgcctccttgagtgacctgcacagggcaggactctgatgttgtgtttcctctttggaaagtgagagggggaaggagtgaagcatgggccatcccaaaatatgccagattgggatattgattattttgagttgaaaatattggatacattgtagtttcggataggactaactgacctgtctcttcatgcctgcagcaagccataaagattcctctgggaaggagacccttcctgtagcaggatgagaaaatgccccttatcatcagagactgggcattggagctgcaatgggcctgagtaaacatatttaacacagtatcccttatcttccactggttttacaccctcctcatatctcctagcgccttctctagaaaatttactccttctagccagattttatttgtcctgtcatttctccttaaatgtatggttctttgtctaaagattataaaagcatgttgttttggccacttctttagacttcactgtcttgtgaggatccccataaacatgtaaaactagtaaaattggtaagcttttcttttgttaatctggcctggtatcaatttggtttctaggtccagctgaagagtccattaagactaaaaaggggttggaggtaatctctggctgtcttacaagggtgagggatgctgtctgccttctcagggctttgtcattgaggctgggaagtccctttgaattccctccaggaccacaccctggaactgatgacaatgcctgcagtgagggaccccctgcatcttctggagggcctcaagcaatagcctgggttaccaggaccagcccttggcgcttctgagttctccttgtggccctgctccaaggaatcttttccttttttttcattcaactgcacctcattgaatttcttatgtttagacaaagtgattcagagctagaaagaaattatttaggcagatagtgagggtaacagagtcctctgtaaggtttccttgcaataaaaagcagctcctaaatcatgtcttttataacaaaaagcagcctgaaaaatcaagctgcaagcatagctaagcaagctaaaagctcacataggtaaatgccggcagctgtgtcaatagaaaagggatccctggagccagggatattcaacatggaggttccctcttccactttccttgttgccacgtgtgcagtaaaaaagcaggcaacaaggctgaggcgggcggatcatgaggtcaggagatcgagaccatcctgactaacacggtgaaaccccgtctccactaaaaaatacaaaaaaattagctgggcgtggtggcgggcgcctgtagtcccagctactcgggaggctgaggcaggagtatggtgtgaacccgggagacagagcttgcagtgagcccagatcgcgccactgcactccagcctgggcgacagagtgagactccgtctcaaaaaaaaaaaaaaaaaaaaagcaggcaacatggcgtcggccaaggagagacctcatctgcataataaaagattagggtggggcagccagtttcttttcgtgttatgtaaatggcctggctgtccaaccgatctttgggccctatgtaatcagactcaagctcgtctataaaacccttgcatttccacacggagccggaagaaccacttgggagcccttgtctctctgcaggaaagagagcttttctcttttctgttgcctattaaacctctgctcttaaactcacttcttgtgtgtctgcatctttgatttccttggcgtgaggcaacgagctcaggtattaccccagacaaacacagctgcttcaaaagtttcagaacatctccccacctcccccaaccctgtttgaggtcactactagaaacactgtaaccttcagaaatatagctttgttgggaaataaatcaaagtctgataaagagctgtgatttctaatatggggcatgggccattgtcatgatttccttttgactggggcttgtgccctggagctgactcctccaagcctgcagaactcactgaaatgcacccctgcagagcggactggggtgggaaccaaggggaaagacattgcctgcctgtgaacctcactcaggttccatcttaaatctccaggcgggaaaatacgtttagaaagaatactctcttaaggagactgttctactgctctactttgctgtaattctggtgaacatccagtgaatatcacgtagactgctttccctccccggtctgcccctggtggaccactctggaaataactgcccactgttacgtgcgtccatggaggacagaggtcggcccagcagcccctatcctgattccttgagtcacaagaatacaccacgagcccaaagggtattcagcagcctcactgcacccacctgggagccaagtgggaggtggtgcccctggctgcgcaccctgctctcttcccacccacctttcactcctcactgttaaacacacaccacaaagaagaatcgacagaagtacatagatcagcatcaacgttaaatgcaaaaactcccccactgcgagttcatttttaattcaaagtttttgcatttgtatcacaatgttttaaactctaccctcctcacccttctacaagaagggaagccttgcaaagggagctgcaggctggaccaaagaacactttcagtaaagggtcataggctgccacgtgcccaagggctgccctccccagggtccagtgctgccagtgcctacctgccaatggttcttacgattctagtttaggcactgggagaattaagccaagacttaggaataaacatcctcttagatccatgagtagcacttccctcttgctgacacttagctctccctgttgcactaacacttggggttggagaagatgctccggggcccaggccaggctcctctcctgagccacggcagcagcaggggcagggaagcatatacccacagtttgcctgctgcctttgtggctgccccctgggtggtttctagatacagaatgagattatttccctgtcactcacaattgtggtagagtgatactcccagggtggggaggggaggtctcggaatcccaggtggcatctgcagcatttggaatagccctcatctttcagaggctctggcaatgtcagctgtatctgaaggcaaacctgattccgcaaagcatcaaatccatggccaggatttgtgatgtcctcctgatcacaaaccacatcgattctcagctgtgtgggctctgtgtgcacagttcagtaccagggaactggagatggcggcttggggtcaccgtgctatgcacgcacaagcaggctgctgagcctggcaaaactgtactcctaattttcagtggcaatgcattttccttccttgctgagctgccctgaacatcacctaagaataatgccaggtgtactttaaaagcataacagcacctgggatccactaagcgagacgtatgacggcagtcagggtggactgaggccaccacttcaaggatgagg

SEQ ID NO: 10480 - DNA, 980 bp, Artificial Sequence
  Incyte LifeSeq database template #LS_1076101.8, human endogenous retroviral sequence (HERV)
gccgctgccgctccaggagacaggttcccatgcaggaatgaaagacatggaagggaagaggggggccagctccctgagtcctgtgtccaccagctgctgctaaatacctctgagaaactctgcttctatctaaggggacctacttctctcgggaatctcaatacttggaacaagaacctcctagacggaccctttggcataatgaattggaccaactgtaggttccaggactagagagccagcaatgcctccatgaacaatctcacccaattactctgctcaggaaacgaggtaactgatggacagccgaggcagccccttaggcggcttaggcctcccctgtggagcatccctgaggcggactccggccagcccgagtgatgcgatccaaagagcactcccgggtaggaaattgccccggtggaatgcctcaccagagcagcgtgtagcagttccctgtggaggattaacacagtggctgaacaccgggaaggaactggcacttggagtccggacatctgaaacttgtagactgggagctgtacatggatgggagcagcttcaccaacccctgcaaagtgactctgaagaagacgacaagccctgctccagtcacacccggaagctgactggtccacgcacagctgaagcatgaggaaactcatcgcgggactaattttccttaaaatttagacttgcacagtaaggacttcaactgaccttcctcagactgagaactgtttccagtatatacatcaagtcactgaggtaggacaaaagattgctacattcctattattttaaggttacatttttggggacccctctttcttctgttctagctattacctttcttgtgtcacctagaaaaggaccagtccttaattgtattttaaaaactgtgatcatgggaagctttaaattggttcaataacacgcatcaagttggttatttcctgggctacataccttggatagat

SEQ ID NO: 10481 - protein, 118 aa, Artificial Sequence [sequence omitted]

SEQ ID NO: 10482 - DNA, 2007 bp, Artificial Sequence
  His-Ly1452, Ly1452 with His tag
atgcagcatcaccaccatcaccacgtgtcacaatctacagtcaggcaggattctcctgtggagccctgggaagggatcagcgatcactctggcattattgatggttcgcccagactcctgaacactgaccatcctccttgccaattagacatcaggctcatgaggcacaaagctgtctggattaacccccaggatgtgcagcaacagccgcaggacttgcaatctcaggtgccagcagcagggaacagtgggacccattttgtgacagatgctgcctctccctcaggcccttcaccttcgtgcctcggggactccctggcagagacaacgttgtctgaggataccacagactccgttggcagcgcttctccccatggctcgagtgaaaagagtagcagcttctctctgtcctcaacagaggtacacatggtccgcccaggatactctcatcgggtgtctctgcccacaagccctgggattttggccacctccccatatcctgagactgacagtgctttttttgagccttcccatctgacatctgctgctgatgaaggtgctgttcaagtcagtagaagaaccatttcttcgaattccttctcaccagaggtatttgtgctgcctgttgatgtagaaaaggaaaatgcccacttttatgttgcagatatgattatatcagcaatggagaaaatgaagtgtaacattctgagtcaacagcagacagagagctggagtaaagaagtcagtgggttacttgggagtgatcagcctgactctgaaatgacttttgataccaacataaagcaagagtctgggtcttctacttcttcatacagtggctatgaaggttgtgctgtgttacaggtcagcccagtgactgaaacacgtacttaccatgatgtgaaagagatttgcaaatgcgatgttgatgaatttgttattttagagcttggagattttaatgatatcacagaaacctgtagctgttcctgcagctcctctaagagtgtcacttatgagccagacttcaattctgcagaactattagccaaagagctgtaccgcgtgttccagaagtgctggatactgtcagtagttaattctcagctggcaggttccctgagtgcagctggctcgatagtcgtaaatgaagagtgtgtccgaaaagactttgaatccagtatgaatgtagtacaggaaattaaatttaagtctaggatcagagggactgaagactgggctcctcctagatttcaaatcatatttaatattcatccaccactcaagagggaccttgtggtggcagcccagaattttttctgtgccggctgtggaactccagtagagcctaagtttgtgaagcggctccggtactgcgaatacctagggaagtatttctgtgactgctgccactcatatgcagagtcgtgcatccctgcccgaatcctgatgatgtgggacttcaagaagtactacgtcagcaatttctccaaacagctgctcgacagcatatggcaccagcccattttcaatttgctgagcatcggccaaagcctgtatgcgaaagccaaggagctggacagagtgaaggaaattcaggagcagctcttccatatcaagaagctgttgaagacctgtaggtttgctaacagtgcattaaaggagttcgagcaggtgccgggacacttgactgatgagctccacctgttctcccttgaggacctggtcaggatcaagaaagggctgctggcacccttactcaaggacattctgaaagcttcccttgcacatgtggctggctgtgagctgtgtcaaggaaagggctttatttgtgaattttgccagaatacgactgtcatcttcccatttcagacagcaacatgtagaagatgttcagcgtgcagggcttgctttcacaaacagtgcttccagtcctccgagtgcccccggtgtgcgaggatcacagcgaggagaaaacttctggaaagtgtggcctctgcagcaaca

SEQ ID NO: 10483 - protein, 669 aa, Artificial Sequence
  His-Ly1452, Ly1452 with His tag
MQHHHHHHVSQSTVRQDSPVEPWEGISDHSGIIDGSPRLLNTDHPPCQLDIRLMRHKAVWINPQDVQQQPQDLQSQVPAAGNSGTHFVTDAASPSGPSPSCLGDSLAETTLSEDTTDSVGSASPHGSSEKSSSFSLSSTEVHMVRPGYSHRVSLPTSPGILATSPYPETDSAFFEPSHLTSAADEGAVQVSRRTISSNSFSPEVFVLPVDVEKENAHFYVADMIISAMEKMKCNILSQQQTESWSKEVSGLLGSDQPDSEMTFDTNIKQESGSSTSSYSGYEGCAVLQVSPVTETRTYHDVKEICKCDVDEFVILELGDFNDITETCSCSCSSSKSVTYEPDFNSAELLAKELYRVFQKCWILSVVNSQLAGSLSAAGSIVVNEECVRKDFESSMNVVQEIKFKSRIRGTEDWAPPRFQIIFNIHPPLKRDLVVAAQNFFCAGCGTPVEPKFVKRLRYCEYLGKYFCDCCHSYAESCIPARILMMWDFKKYYVSNFSKQLLDSIWHQPIFNLLSIGQSLYAKAKELDRVKEIQEQLFHIKKLLKTCRFANSALKEFEQVPGHLTDELHLFSLEDLVRIKKGLLAPLLKDILKASLAHVAGCELCQGKGFICEFCQNTTVIFPFQTATCRRCSACRACFHKQCFQSSECPRCARITARRKLLESVASAAT

SEQ ID NO: 10484 - DNA, 369 bp, Artificial Sequence
  His-TCL-1, TCL-1 with His tag
atgcagcatcaccaccatcaccacgccgagtgcccgacactcggggaggcagtcaccgaccacccggaccgcctgtgggcctgggagaagttcgtgtatttggacgagaagcagcacgcctggctgcccttaaccatcgagataaaggataggttacagttacgggtgctcttgcgtcgggaagacgtcgtcctggggaggcctatgacccccacccagataggcccaagcctgctgcctatcatgtggcagctctaccctgatggacgataccgatcctcagactccagtttctggcgcttagtgtaccacatcaagattgacggcgtggaggacatgcttctcgagctgctgccagatgactgatga

SEQ ID NO: 10485 - protein, 121 aa, Artificial Sequence [sequence omitted]

SEQ ID NO: 10486 - DNA, 524 bp, Homo sapiens
gtgaaacaccctcggccgggaagtcagttcgttctctcctctcctctcttcttgtttgaacatggtgcggactaaagcagacagtgttccaggcacttacagaaaagtggtggctgctcgagcccccagaaaggtgcttggttcttccacctctgccactaattcgacatcagtttcatcgaggaaagctgaaaataaatatgcaggagggaaccccgtttgcgtgcgcccaactcccaagtggcaaaaaggaattggagaattctttaggttgtcccctaaagattctgaaaaagagaatcagattcctgaagaggcaggaagcagtggcttaggaaaagcaaagagaaaagcatgtcctttgcaacctgatcacacaaatgatgaaaaagaatagaactttctcattcatctttgaataacgtctccttgtttaccctggtattctagaatgtaaatttacataaatgtgtttgttccaattagctttgttgaacaggcatttaattaaaaaatttaggttt

SEQ ID NO: 10487 - DNA, 289 bp, Homo sapiens
ctgcttgtacttcaaagccctccgtctagccatctcagccaggctcaggttccttctcccacccatcaggccaagcaggacttgtcaaacatacacattcaagttcctagcacacagtaggtgctaagtgggaattgattataaacttgaattcttccatcaacaaatatccacctctcctgtccagcttgcctcagatcttcaggttctctcttctctgaggcagctaagcttctacatccttcatgaagtttcctttacttctcgacagaagacagttccctttagg

SEQ ID NO: 10488 - DNA, 302 bp, Homo sapiens; identical to SEQ ID NO: 2884

SEQ ID NO: 10489 - DNA, 562 bp, Homo sapiens
tataaactgtggcgggatagttttcgggtccttgtccagtgaaacaccctcggccgggaagtcagttcgttctctcctctcctctcttcttgtttgaacatggtgcggactaaagcagacagtgttccaggcacttacagaaaagtggtggctgctcgagcccccagaaaggtgcttggttcttccacctctgccactaattcgacatcagtttcatcgaggaaagctgaaaataaatatgcaggagggaaccccgtttgcgtgcgcccaactcccaagtggcaaaaaggaattggagaattctttaggttgtcccctaaagattctgaaaaagagaatcagattcctgaagaggcaggaagcagtggcttaggaaaagcaaagagaaaagcatgtcctttgcaacctgatcacacaaatgatgaaaaagaatagaactttctcattcatctttgaataacgtctccttgtttaccctggtattctagaatgtaaatttacataaatgtgtttgttccaattagctttgttgaacaggcatttaattaaaaaatttaggttt

SEQ ID NO: 10490 - DNA, 289 bp, Homo sapiens; identical to SEQ ID NO: 3644

SEQ ID NO: 10491 - DNA, 315 bp, Homo sapiens
aaaaaaacaaaacaaagcaaagcaaagcaaaacaaaacagctctttataatgtacaatggcttaagcaaatcgctttagttttttttctatttaagatttaggacagactactcgtctaaaattcactatttacagagaaggtcctagggaacaggataacttatttaggtttagctctcataatacaatatccataatggctttagaagaatgtaaataaataacattggtaaacagcgtatactgatattttctgacaaactcatttatctaacatcatgctgagcaatcaagaggattcctctatatatttt

SEQ ID NO: 10492 - DNA, 526 bp, Homo sapiens
aaaaaaaaaatcaaaagcagacatgtttggctgaaataaaaccaagaaacacagctaaaactcccccataaacctaaaagtccatggagaattcaatttctcatttccattcagaaatctggctacaaagtgatttgtttgctatttgggacagtacagagtgctgaaagaaacccagctcttgagtctcttagatcccatcctgtaggaagtggtgggaaagccagcggaccatgggcaagtcaactcctggctacttggcagggagtcagactgtgctctctccattccccaggactccacagaaccatctggtactgctagtgctgggtgaacagtgagagcagagtccacaaaacgcagagaaccagaatgtgaccgcaaggagccaggaccttgtgctttttcatggattacaaatctagggccaaggagagggaaagcagaaagagccctattgggaagaggagctggctgcgcccctaaactgagatggaaagagtaaggctcttgagcccacacctgg

SEQ ID NO: 10493 - DNA, 637 bp, Homo sapiens
  misc_feature (1)...(637): n = g, a, c or t
ctgggcaanaccaagtcacagtttccagcgtgctgctcagccctccgagtgtgtgtgctcatccttttcatagaagtcccatmkgscatggagagggttgggctgcaragctgwgattgccagaggcccttccttgagaactgtggggaaggaggccctgggggtttcttctgtaggcagagctcaggccccagtcacctctgccaccctcagcctggcactgttgtgccagagcctctgctgcctctctcttcctacccatctgcagaccagcagaatattctccccctctcatcaccaaccaggagtttggtgtggtttctggacacggccagagcagtcactgcggggctggttttgctgggcttccctgtcaaagcaatgctaacgtccagctctcgactcaaggccaggttcttctcccacttgtggcctcttgggcttggaggctgagccaggggctcctctcctgctggccgtccaggaacagacatcttcacatcctcagtcttccaaacccggaccatgccgtcttgactcccggtgatgatgatctggcttgtgtcccatgctgggccctccatcaggcagcaacaggttatggctccttctgggccccaggctgtggtgatgctgg

SEQ ID NO: 10494 - DNA, 545 bp, Homo sapiens
  misc_feature (1)...(545): n = g, a, c or t
aaacaatgctacactcatttttggcaaagtgctgtattgttcagtctgtgtacaaaactgaccatctatgaaccaatcagtataaaaaatttctataaaaacaaaatttagacagtggctcaagaaaacaagctgccatttatgcatagattgatgtacagtaacctaaccaaatgtcccttttgaattttcaagttactgaaaaaaaatgtgtcgagaaacacattaagaaggcacatgtacagtctacaatactcttcagtctccctaactcatgccctgcccctataaaggaaatatgttcacaattttacttgagaaaaaaaaacaaagccacttaaaaaaaaaaaacacacacgcaattattaaagttcaaaatctctggaggaaaatacaagcaaaaccactcatacactccaagcctgaaacacacatctaacctccccaggtactggtttggttttcagaggtccacctanaaaacaaatactaaaacttcaggcaaaacagagcaaaactggacatttaacaattacacaattttt

SEQ ID NO: 10495 - DNA, 210 bp, Homo sapiens
ctgaataggcacccaaaagtccgtgactaaatttcgtttgtctttttgatagcaaattatgttaagagacagtgatggctagggctcaacaattttgtattcccatgtttgtgtgagacagagtttgttttcccttgaacttggttagaattgtgctactgtgaacgctgatcctgcatatggaagtcccgcttcggtgacatttcctgg

SEQ ID NO: 10496 - DNA, 595 bp, Homo sapiens; identical to SEQ ID NO: 8073
  misc_feature (1)...(595): n = g, a, c or t

SEQ ID NO: 10497 - DNA, 737 bp, Homo sapiens
ctgtggctgtctgtcagagaagcacatttttctgcagataattagaatggcttcccccatctctcacggactgtcccaagtctagaaaagaattgagttcctcttctattagtcaaataaaagggaagagaatgtttgtcttcctttcctttctgtagtgttaagaaaataaacgaacttaatgattctaaattatcagtgagcttaacactgtactatagaccaaagattaccttttcaaaaagtcctttgaggtgaaatattttgtatacgtaatacatagatgcacatataaacacacacatatagaatctcaatattttaacacttctttgggtagttgtactaactcactaaccctgaggaaaaagttaagaaattgaaagtgttttcttcaaaagttgagatttaacaataaaaggtgttactttgataactaaaaggaactttattatcctcttcctaaaataaaccaatgcctattctgaaaatggcacttgcaattacaatttgccattatcaaagctaccactgaggtagaggcattatctaaaacaaataccacttatcatttattggcagttacctcgagagagacccatacaccatcttctagcagagcacagtcaatcaaattaccttcgggtaaagctatagcatgtctagtcgtttgacagatattaaaggtggtcataaaagaaacataaaccataggctgtgctccaaaggcatattgg

SEQ ID NO: 10498 - DNA, 501 bp, Homo sapiens
ctgtacgttacaagtttggtcattttgaagcttgacattttagtttgccattatgttaaaaacatctaaataggtgttagtttctcaggagtagattgttagtgttgacttttcctgtaaagcagacatcgttcttggcctgccctgcattgtatactagatttcattgttgtctctcatgcttcttgagttgcttcatggtttatgctcgccatggaaagctatcagtaacagtttcatgcttataccaaagaattaaatctgatctttaatatctgatattttcctggtactcgtactgataagggattattggaagtcagtcacagaatttggaaataaattctagtctctccttagctatttgatgcttttcatataggccaagaactcattgcaaaacatttttgcaaggatgaatgcctgtatttggtctaggaacagtacattttagtctgatttagaattactggtagcttattttaaagcaaggaaaagcag

SEQ ID NO: 10499 - DNA, 528 bp, Homo sapiens
ccacaagctctttagatggttacttttagtaaactcttcattcatcctggcattcttgaaaatattcgtcaaacatagaggaagactcatcttcacgttcctttggttctttaaattctaggtcttctccatattgaatggcaaaatcaatatgctgcaatacaatgttcatgctttcttcatctgactgatcgtaaggtaaaaatcgaaccatgctgtagtcatcaatcagtccacatatagctttagtcagtttcttgaattttttgcttcttaagtcacttgtagaatcttctaataaagaatacatgtctggatctaaaaatttctcaatttccttttttgcttttttactcagcagatccatttttgtcatgatgttgacttgcggaatttctagagagatcatggcactcagggctgccaagatgccagaaataaacttgaatgactccaccatgaactgagaatcaacaagaaaaactccacagactcggaactcccactgctcgagctgctggaccagct

SEQ ID NO: 10500 - DNA, 486 bp, Homo sapiens
actaaacagccaatcatggtattcaaaggacaccgtaaagcagtctcttatgcaaagtttgtgagtggtgaggaaattgtctctgcctcaacagacagtcagctaaaactgtggaatgtagggaaaccatactgcctacgttccttcaagggtcatatcaatgaaaaaaactttgtaggcctggcttccaatggagattatatagcttgtggaagtgaaaataactctctctacctgtactataaaggactttctaagactttgctaacttttaagtttgatacagtcaaaagtgttctcgacaaagaccgaaaagaagatgatacaaatgaatttgttagtgctgtgtgctggagggcactaccagatggggagtccaatgtgctgattgctgctaacagtcagggtacaattaaggtgctagaattggtatgaagggttaactcaagtcaaattgtacttgatcctgctgaaatacatctgcag

SEQ ID NO: 10501 - DNA, 512 bp, Homo sapiens
  misc_feature (1)...(512): n = g, a, c or t
cctcccctgcagctctctgtgtytgtgatgatggagctgggttggggaaatcctgctgtgacatttgccctgacgcagttccgcacagcatggtggcttccaagctatgctcttgatgggcacccgtaaggagcttctacatgcattagagatggagcctctcctatctttgcaagcctttgtggttcttccctttaaatctgccatccacggacctcaacaggagaataatttggtcttcagtttgctctgttttagacaaatacttcacatgactgatgtaaactgttgcatagtttcacaaaggctttctcattcattcctgaaattctccatcagtcacaaacacaaattgttcagtatctggggaattcaaagccctttcctcaaaacagacatttctccttatcattcttccttcaggggaagtattgaaagtcattgaaagtcatccccacccactagaggagagaaangcaagcccagaaaaggcaagaggtacacaggcancc

SEQ ID NO: 10502 - DNA, 433 bp, Homo sapiens; identical to SEQ ID NO: 8312

SEQ ID NO: 10503 - DNA, 399 bp, Homo sapiens; identical to SEQ ID NO: 8666

SEQ ID NO: 10504 - DNA, 218 bp, Homo sapiens; identical to SEQ ID NO: 3998

SEQ ID NO: 10505 - DNA, 265 bp, Homo sapiens
  misc_feature (1)...(265): n = g, a, c or t
cctagttgaaagtcaagaaggacagcagcaagcataggctcaggattaaagaaaaaaatctgctcacagtctgttctggaggtcacatcaccaacaaagctcacgccctatgcagttctgagaaggtggaggcaccaggctcaaaagaggaaatttasaatytctcattgggagagtaaggtaccctcatcccagaatgataactgcacagtggcacaacaaactccaccctactgcgggtggaccccatccagtctgttgaang

SEQ ID NO: 10506 - DNA, 420 bp, Homo sapiens
cctccaggcttctagagcagctagcttgggctggattctcacacccaggctgccccttggattgttctacccaagcttttccctggggtctgggctcactccataaggtaaggtgccttttaccttatggtccttctttagcaggtaacaaaggagcatcaggggcaggctgccctggtggcatcacactggctagtgaggccgtgaatatcttgtcccccagcagggccgacagtttctatcacagaaaacagtgtgttcagtggtgaaaatcgttgcatgcatgttttcatctgagcgtgtccttctcccatactccctatcagccagccctgcctgtagctgctgtatggtgattgcacttggacatcagtccaatgactgcaagtcggcctggattttcacttgcagaggctacag

SEQ ID NO: 10507 - DNA, 456 bp, Homo sapiens; identical to SEQ ID NO: 4235

SEQ ID NO: 10508 - DNA, 610 bp, Homo sapiens
aaaagaaaattctaccgaaaggcaatacatctgtgtttcaatgccaggtgcaaaggatatagctctatgactgcttacaaaggaaacacatcccagccaagacacaggacactggtcaggacccccggggcctccctccagcacctgtcatcccaggcccccaacagaggagaacccagttccaacttctaacactgtccaccagtggggcctggttctgaatactacagaaatggaatcccacagtctatccccttgggtctcaggcttcttggactcagcgttatgtccgaggcatcactggtggggccactgatcatacagtagccacagctcgctcttttggctgctgtggagtcccccgtggcatgaattcagcaggtgctgcttttctgtgctggtcagactgggcggtgttccaggttgtgtcactgcgtgggggctgctatgagcattctcccatgtgacttctgtcaacacacagttgtcctgtctccacgggggagtggccgaggacttccacagataccagaatctgtgggtgcgcaagtccctgatataaaatgacttggtattttcatacaacctacgcacatcctcccatatattt

SEQ ID NO: 10509 - DNA, 730 bp, Homo sapiens
gaaatgcattttcccttgtcctgtctttaactagatatacatgcttatatttatagtgggtttcacagactataaaattgaatgtatgaaatttttatttatatcagtgcttttaataatgaagatatttttggagtaatggtgctgtcttgtagcgagttattaatcatagtaagatttttttctcttcatttgctttttttgtttcatattaacaatttttttttttacacggacacaaccctctgacagtctttccaaatattaaaatcatttgaatatgtatgctgtgatctgaacactgctcaagtcatcaagcagtcttcatacagtttgcattataaaatctcattaaattctccaagaaaaaataagttgaagaattttatttcctgaccatgcatcccctggatttctgagtttcagttcagattgtagatgacaatataagctgccttccgaaattgtcaacatctgaatgttaagtccattttccccatggaagaagcccgtagttccatgaagtatggattaccatttgtatttttcactaacagtaaatgtatttttcttattaattgtttgccttaggaatgatgaattacattttttgttccttcttaccgtaaacatctgcattcctcagctcagccttccttgtatgttgtttctttataaatggttgagctgctgatgcaggtattgccaagctaacagtacaaatcatttt

SEQ ID NO: 10510 - DNA, 510 bp, Homo sapiens
aaaaaatgggaaattttaatattaagtatgtccatgattgaaagaatcattccagaaatggcagcaaagaggctcaatgaattcattatcatttttcctttgaccaaacacttcctggagtttttctccgttgctgccaggagtgatccggaaataatatacataatgcctccccagggagggtaccacacagtcacacagatgggtgcatagatccctgctgggatcatcagaagaccccccagggcaatgtggaagagcccattcataatctggacagcccccaaagtcttagattccctcatgaagaagctttgcgtggggcccaccagtgaagacatcctcctgaagagtggttttggaccagattgcatagcaatagggcctttcattggctctgccgggaaagtcccatttactgaatttctgggtgttgtcattttgctctcaaaactcctaaaaataaaacaaataacaaaatgaggagagcaagaacaagaattttggcag

SEQ ID NO: 10511 - DNA, 526 bp, Homo sapiens
cctgtcctcttaggactcaaacccagaccctggactgattttccagtccccaccgtcctgcgggacagccagcgtatgctaatgttgcaaacccatgataatgtatgtggaatatcctgccattggggttttacattaaaaccccagaatggctgcagaggggtgaacaggccccaatatttggggtgctgtgatacccctcttctacccacaaggagccctcttgatgatttctgtgaaatcgaggccccttgattgtttctgtgaaacaccctgcacccctagtcctttccccactgagatctttcgggttctctcccctaactcagctcttcgttcccagaaacccagatgtaatccccctacgtggtgcttggggcatcccgataccatctcagtaaatctcctacaatggcctcctcaccctccccgggacccacacccttcaggtcctcaccctgagacaggagggaccctctgagatcagggacccttaggtctcactgctctctgattcagagctcag

SEQ ID NO: 10512 - DNA, 295 bp, Homo sapiens
atcgttgagaatgaatggaaaagaacgtgctccagacccaaatctaacatagttctcctgtcagcagaagaaaaaaaagaacagactattgaaataaaagaagaagtggttgggctaactgaaacatcttcccaaccaaagaatgaagaagacattgaaattattccaatccaagaagaggaagaagaagaaacagagacgaactttccagaacctccccaagatcaggaatcctcaccaatagaaaatgacagctctccttaagtgatttcttctgttttctgtttcctttttt

SEQ ID NO: 10513 - DNA, 364 bp, Homo sapiens
ccagaacgcagagactttatgatgaggacggtgcccacgatgatgccgactaggcccagcaccaggcccagggcacagagcacagtctccgttgtctcaggcatctggattggctcttgggcctcccagtgcttgaggagcggctggtccaagccccagtgctccaccctgcagtcatagaagtcctctgctgagggcacaaaggtcaggtaatggaacttgtggaagctgtaatctgttctgggcaggaagaggctctcagcgacaccctcagtgaccagctccccgttgcacagccacgtgacgttgagcgctggtgggaagaacttgtcaatgtggcagatgagggtgttgggctggccca

SEQ ID NO: 10514 - DNA, 200 bp, Homo sapiens
  misc_feature (1)...(200): n = g, a, c or t
ttctgtgggacttccactgctcaggcgtcannctcagatagccgctggccgcgtacttgttgttgctttgtytggagggtgtggtggtctccactcccgccttgacggggctgctatctgccttccaggccactgtcacggctcccgggtagaagtcacttatgagacacaccagcgtggccttgttggcttgacgctcc

SEQ ID NO: 10515 - DNA, 293 bp, Homo sapiens
  misc_feature (1)...(293): n = g, a, c or t
ccaccctgaccatcaacagggtcgaagccggcgatgaggccgactattactgtcaagtgtgggatcgtaataatgaccatgtcgtcttcggcggagggaccaaactggccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatancagccccgtcaangcgggagtggagaccaccacaccctcc

SEQ ID NO: 10516 - DNA, 334 bp, Homo sapiens
ccaaaactgcgaagagatgcagaataatgttgacaataataagttgctgaatcgtcaggctgcagactggtgatggttaaattgaattgtgtcccaaatccactgccagtaaatcttaatgagaccccttcttctaaactggaagtcgcataaattaggacattaggggctttgcctggtttctgttgatgccaggccaaccaccgatctatattctgagaggcccgacaacttattgtaactgtatctccgacagatgcagacagggtggaaggagattgggtcatctggatgtcacatttggcacctgggagccagagcagcaggagcccca

SEQ ID NO: 10517 - DNA, 617 bp, Homo sapiens
  misc_feature (1)...(617): n = g, a, c or t
aaaaaatgggaaattttaatattaagtatgtccatgattgaaagaatcattccagaaatggcagcaaagaggctcaatgaattcattatcatttttcctttgaccaaacacttcctggagtttttctccgttgctgccaggagtgatccggaaataatatacataatgcctccccagagagggtaccacacagtcacacagatgggtgcatagatccctgctgggatcatcagaagaccccccagggcaatgtggaagagcccattcataatctggacagcccccaaagtcttagattccctcataaagaagctttgcgtggggcccaccagtgaagacatcctcctgaagagtggttttggaccagattgcatagcaatagggcctttcattggctctgccgggaaagtcccatttactgaatttctgggtgttgtcattttgctctcaaaactcctaaaaataaaacaaataacaaaatgaggagagcaagaacaagatttttggcagtcttaccttgtgtcatgcatctgaatgcttctctcagcctttcctncatggggtgtcattganggtagacatggnctcttccgagtgaccttggatctgaggcaagg

SEQ ID NO: 10518 - DNA, 485 bp, Homo sapiens
aaaaatggagagtctgaattttattagagctcacacaccatatattaacatatacaactgtgaaccagctaatccctctgagaaaaactccccatctacccaatactgttacagcatacaatctctgttcttgggcattttgtcagtgatgctgatctttgccttcttccaggaacttgtaatagctggcatcgttgagaatgaatggaaaagaacgtgctccagacccaaatctaacatagttctcctgtcagcagaagaaaaaaaagaacagactattgaaataaaagaagaagtggttgggctaactgaaacatcttcccaaccaaagaatgaagaagacattgaaattattccaatccaagaagaggaagaagaagaaacagagacgaactttccagaacctccccaagatcaggaatcctcaccaatagaaaatgacagctctccttaagtgatttcttctgttttctgtttcctttttt

SEQ ID NO: 10519 - DNA, 456 bp, Homo sapiens
  misc_feature (1)...(456): n = g, a, c or t
cctcacactttcccatgaaaagggtgaatgtatataacctgagccctctccattcagagttgttctcccatctctgagcaatgggatgttctgttccgcttttatgatatccatcacatcttatcttgatctttgctcccagtggattgtacagtgatgacttttaagccccacggccctgaaataaaatccttccaagggcatnggaagntcactccacctgaaccatggctnttcatgcttncaagngtctgggccttgcccagatagacagggctgactctgctgccccaacctttcaaggaggaaaccagacacctgagacaggagcctgtatgcagcccagtgcagccttgcagaggacaaggctggaggcatttgtcatcactacagatatgcaactaaaatagacgcggagcaagagaaatgcattcccaccgaggccgcttttttagg

SEQ ID NO: 10520 - DNA, 259 bp, Homo sapiens
cccaaatctaacatagttctcctgtcagcagaagaaaaaaaagaacagactattgaaataaaagaagaagtggttgggctaactgaaacatcttcccaaccaaagaatgaagaagacattgaaattattccaatccaagaagaggaagaagaagaaacagagacgaactttccagaacctccccaagatcaggaatcctcaccaatagaaaatgacagctctccttaagtgatttcttctgttttctgtttcctttttt

SEQ ID NO: 10521 - DNA, 603 bp, Homo sapiens
ccagaaattctcccttgcctccttgattgtggtgtcccagatgtagtattcccacaggggtctggcaggcccctcctgtaaccactccagtcacattttctgctcttgaggcagaggtgacatcaggacgtttacagcctccacatgaattgagtgttcatttacctcagtattaccgtgttcatttttgtcctcgtgctacagttagctccctgccgcctcttgcaggtcttacttcagctcttgcctgtgacccacacagcttctgggctctgcctctgctctaagaagtgctgtgggggtagagagccaggaaggacatgctgttgggaatgtacacctgggcagaggtggccctgttaagatgtgactgtagccacagccagggatgggatccctgggtctctggaatctgaaacctcaacaaataccagtcttgacccctagcagcagagataagaataaaggggttggtttgctattaagtcagatgggggctctctccttgtcatgctgtccctgtgggtaacagacagggattgaccatcttactgttgtacaggtagctggtggtgttggattatcccattgaagctgggacag

SEQ ID NO: 10522 - DNA, 222 bp, Homo sapiens
ccatgtccccagaattgaagccagagaatcgctcagatatccctgagggccggtcgttatcaaaagagatgattaggacaggggcctggcctggcttctggtaataccagtgtacattgtgactcccaatattgtttcccccacaggtaatcttggccgtctttcctggggccactgacactgagggtgtctgagtcaacacataggaggtcacagagtctg

SEQ ID NO: 10523 - DNA, 616 bp, Homo sapiens
aaaaaatgggaaattttaatattaagtatgtccatgattgaaagaatcattccagaaatggcagcaaagaggctcaatgaattcattatcatttttcctttgaccaaacacttcctggagtttttctccgttgctgccaggagtgatccggaaataatatacataatgcctccccagagagggtaccacacagtcacacagatgggtgcatagatccctgctgggatcatcagaagaccccccagggcaatgtggaagagcccattcataatctggacagcccccaaagtcttagattccctcatgaagaagctttgcgtggggcccaccagtgaagacatcctcctgaagagtggttttggaccagattgcatagcaatagggcctttcattggctctgccgggaaagtcccatttactgaatttctgggtgttgtcattttgctctcaaaactcctaaaaataaaacaaataacaaaatgaggagagcaagaacaagatttttggcagtcttaccttgtgtcatgcatctgaatgcttctctcagcatttcctccatgagtgtcattgagggtagacatggcctctttccagtgaccttggatctgaggcaagg

SEQ ID NO: 10524 - DNA, 431 bp, Homo sapiens
  misc_feature (1)...(431): n = g, a, c or t
aaaaaatgggaaattttaatattaagtatgtccatgattgaaagaatcattccagaaatggcagcaaagaggctcaatgaattcattatcatttttcctttgaccaaacacttcctggagtttttctccgttgctgccaggagtgatccggaaataatatacataatgcctccccagagagggtaccacacagtcacacagatgggtgcatagatccctgctgggatcatcagaagaccccccagggcaatgtggaagagcccattcataatctggacagcccccaaagtcttagattccctcatgaagaagctttgcgtggggcccaccagtgaagacntcctcctgaagagtggttttggaccagattgcntagcaatagggcctttcattggctctgccgggaaagtcccatttactgaatttctggg

SEQ ID NO: 10525 - DNA, 378 bp, Homo sapiens
ccaaaactgcgaagagatgcagaataatgttgacaataacaagttgctgaatcgtcaggctgcagactggtgatggttaaattgaattgtgtcccagatccactgccagtaaatcttaatgagaccccttcttctaaactggaagtcgcataaattaggacattaggggctttgcctggtttctgttgatgccaggccaaccaccgatctatattctgagaggcccgacaacttattgtaactgtatctccgacagatgcagacagggtggaaggagattgggtcatctggatgtcacatttggcacctgggagccagagcagcaggagccccaggagctgagcggggaccctcatgtccatgctgtgtcctgactgg

SEQ ID NO: 10526 - DNA, 616 bp, Homo sapiens
aaaaaatgggaaattttaatattaagtatgtccatgattgaaagaatcattccagaaatggcagcaaagaggctcaatgaattcattatcatttttcctttgaccaaacacttcctggagtttttctccgttgctgccaggagtgatccggaaataatatacataatgcctccccagagagggtaccacacagtcacacagatgggtgcatagatccctgctgggatcatcagaagaccccccagggcaatgtggaagagcccattcataatctggacagcccccaaagtcttagattccctcatgaagaagctttgcgtggggcccaccagtgaagacatcctcctgaagagtggttttggaccagattgcatagcaatagggcctttcattggctctgccgggaaagtcccatttactgaatttctgggtgttgtcattttgctctcaaaactcctaaaaataaaacaaataacaaaatgaggagagcaagaacaagatttttggcagtcttaccttgtgtcatgcatctgaatgcttctctcagcatttcctccatgagtgtcattgagggtagacatggcctcttccgagtgaccttggatctgaggcaagg

SEQ ID NO: 10527 - DNA, 576 bp, Homo sapiens
  misc_feature (1)...(576): n = g, a, c or t
aaaaaatgngaaattttaatattaagtatgtccatgattgaaagaatcattccagaaatggcagcaaagaggctcaatgaattcattatcatttttcctttgaccaaacacttcctggagtttttctccgttgctgccaggagtgatccggaaataatatacataatgcctccccagagagggtaccacacagtcacacagatgggtgcatagatccctgctgggatcatcagaagaccccccagggcaatgtggaagagcccattcataatctggacagcccccaaagtcttagattccctcatgaagaagctttgcgtggggcccaccagtgaagacatcctcctgaagagtggttttggaccagattgcatagcaatagggcctttcattggctctgccgggaaagtcccatttactgaatttctgggtgttgtcattttgctctcaaaactcctaaaaataaaacaaataacaaaatgaggagagcaagaacaagatttttggcagtcttaccttgtgtcatgcatctgaatgcttctctcagcatttcctccatgagtgtcattganggta

SEQ ID NO: 10528 - DNA, 279 bp, Homo sapiens
ccatgtccccagaattgaagccagagaatcgctcagatatccctgagggccggtcgttatcaaaagagatgattaggacaggggcctggcctggcttctggtaataccagtgtacattgttactcccaatattgtttcccccacaggtaatcttggccgtctttcctggggccactgacactgagggtgtctgagtcaacacataggaggtcacagagtctgtgcagtgagagaggaggccgaggaggagaacggtccaggccatggctgaggcaccac

SEQ ID NO: 10529 - DNA, 678 bp, Homo sapiens
cctcctgctgctcctgtttgtgggactgttcatctcctacgtgatgctgaagagcaagagagtgaccaagaaggctcagtgaaggtcccgcagggatgaggctgccagccccttctctgcttcccctccagcacagggaccaagtgggggagcctgcagaacctgtccaggcacagtggctcctcaagcctgcctgtcctgcagagtccccatggcatggagcttacacctgactgactggagccccctccccgactcccacttccagaagctaggagggagggatacctggaagactccggtcacctccttcttgctcagggcctaaaagatgctggtcctcccaacctcactctcagactccctgccaccttttcccctgggttctgccgtcttgcctcacttcccctcctgtcacatgctgacgttggacttagcaggttctaaggccacatgtgtgacctctctgacttctcttcctccaccaaggcagctttccttaccctgacacagccccagaccccacaaagccttmtggacctggaaagcctggggaaggwctgacagaccccaggaccagccctggggctcagggcagccaccccgggccgctgacygactgacctctcctcacggaggcccagccccaaagccccagggctggcccgtttgggacag

SEQ ID NO: 10530 - DNA, 475 bp, Homo sapiens
aaatatggttgtacatgtcatcattaatcgattcattggtcttccacatggttatttcaatgcaagatccgatcagcatgaagagtctagtacaagataggcagacatggttatcactctgcatcaccagtcacatggttacagaaaacagaattgggactgcatagggactctactgcgggcccaacaacctattagtggattgatgtaaggcattagtaaattggcatataaaaatagcttaatgagtgatctaatccatttagaatgctgaagcacttctgtggtaaatgttagtctattctacaattgaaaatgcctcattttaccttttctctaaactgacaaatgcaagtagccagtaactgtaggtctagaattttcgttcactgaccagaaggactaataggcgtctatgtgctcagaaccaccagtcccgcaccaactctcctttcagtgagcactgtcagccaca

SEQ ID NO: 10531 - DNA, 251 bp, Homo sapiens
  misc_feature (1)...(251): n = g, a, c or t
acancctgaccatnaacagggnataaaccggtcgatgaggccgactattactgtcaagtgtgggatcgtaataatgaccatgtcgtcttcggcggagggaccaaactggccgtcctaggtcagcccaaggctgccccctcggtcactctgttcccgccctcctctgaggagcttcaagccaacaaggccacactggtgtgtctcataantgactnctacccgggagccgtgacagcggcctggaaggcaga

SEQ ID NO: 10532 - DNA, 255 bp, Homo sapiens
caacatgccttctgcatcttttaatactacattcacctgattataaatctccttctcagactctgtaggctgggcattttcaaaatcaaggaaaaaatttggcccctgctcaaggtctgtgcatgtcaaaactttaagaagattccccatgttaaggtaccttcagccagygctggbgattctgtccttgbccttctatccttggattggcgttccctctttcctagttcacttgttccagtscttcaacttctg

SEQ ID NO: 10533 - DNA, 645 bp, Homo sapiens
aaacattcaatttatttgtggcatttgtacatgaaaattatatgacgataacattgctttctattctaagctagtaaattgtttctaagaaataatagattgataaaattgcaagtcttaatacaaaggtaggttatgaaaatgtatattaatttgagatatagaaaagttttcaaataataatgttttcagggttatatgcaaatagacactaaataagacaaggtttctgcaaacatgatgtaacaataatgactggaactctgaatgtgggaaattcagaaaatgaaccagctacttaaaaagcaaaaatgtgctaagtaaatttgtattttcatggttattctaaggagaggaggaataatctgttgaggttagtgccctcaagcagaccccataactttgctacaccgcatttaacttctctgtgctgttttcttttaattttcaaaatggaaattagctgtttcattggtgaagtgcattgtaaaatgagagaattttcaaataatgcaattactctatggtattctgttttaatagtaatatacccatatgaagcaggtataatgagaataaattttgcccataacaaattctgaaatctgaagttttggttctgctgttatagtatgaattcgcttt

SEQ ID NO: 10534 - DNA, 432 bp, Homo sapiens
ccaatcatagagatatctgcaccggcctgcaaagcttccatgaacgctttggtcccagacttggcgatagtaccaaggttattgatcaagtcagccttggtcattccaattccagtatccacaatagtgagagttcgatcttgtttgttcggtataaggttaatatgcagctctttcccagagtctaatttactgggatctgtcaagctttcataccggattttgtccaatgcatctgatgaatttgaaatgagctctctcagaaagatctctttgttsgagtagaaagtattgatgatcaatgacatcaactgggcaatttctgcctgaaaggcgaacgtctcaacctcctcctcctccatcggttggtcttgggtctgggtttcctcaggcatcttggctaagtgaccgcacaggaccaacggcacagcc

SEQ ID NO: 10535 - DNA, 365 bp, Homo sapiens
ctgacatgctctcaggggtgaagaagtttagcttaaaatacctgatggcgctgcataaactggggatttgggaactgagtttttagctctgtgacacacaacataaaaaacaaaaatccagtctcattagctaaattcggattaaaatctgaaatgtttttatggagttgccaacaggctggaatgtacctgatacagtttaatctgcttttatttctttggctgtcttccaaaccactttcttcctgtaattcttaagttggctagtcctccttcctcagaaaaattacccctaagaatcttcctaatagtgagggtgtacttccgaatagaagagtccttcggctgaaatggcatctccaagg

SEQ ID NO: 10536 - DNA, 512 bp, Homo sapiens
ccatgggaatctaattaatttcataatgatgttggttgaacatgataccaaaaaatgcaggtattttcaagaacaataagatagataacagcattaaagcataatcctttaagaattcatgagaaaaaaaggatgataaaacttaagcttctttttcagatgtttaaaaatttctataaaattctttgtcccaagattaatcatataaccatggtacataaaatatgctaactacattgcctggtgtcaaggtgggaaaatcctcttttataacataaaatcctcttctaatccatgttgacccaagtcctggctgtctgagggcagattcctgtcaagagacctaaggttgtcatggaaagcatcactttcgtctactagttggtaatcctgttccatttccgttaggaagccactcccagatcctgrccagagcckgagccggagccgaagcctgatccagagtagtcctcakaaagtgggaagatacgattcaagtcctggattmtcgc

SEQ ID NO: 10537 - DNA, 662 bp, Homo sapiens
aaatatgaatttgtcttaaaggcaattcctttttgcttctgtattatctggaaaagcatgagagaggcgacacctcaacaaactgatcagagaaaataagcagttactaccctgataggcaccttcccaatcctgttgcttttgaccattgtctgtccaacggacacacctcaaacaaacaaaactaccaaatagatgacagatcagaataaaggtgagaggtctggtccccattgaaggctgctacagtcttcaaagaggtgaaggagttcataagagaacaacagtaggaaagttgagagccaagggtaggagagktgcccaaaagacttcccctactactttagggtactgaaaactcaaaggatcagctacagctttatctaagtatttactaaatgctacatgagggtgtccctgtccagctttctggcacatgagtcctgtgtggagagttacctcctcttccagggactgtgctgttgggaactttgggcaagtcacttacctctttgtgcctcaatttctgtataatatttctaagctacctcactgaggtggtatgaagattcactaatgtatgtggcgtgtttgtcaatcctccagtgaaaagcactatctagatcacattttggatcacattagccaaatgcagtaaatgg

SEQ ID NO: 10538 - DNA, 369 bp, Homo sapiens
ccaagggagtgagtgggactgaaaatcctgcccctgctccatgctgagccacatacaaagtccccccagtatattgtggggcccttctgggcagacatggagagcttctgaaagtcccacatgcatggaattattttcaagaccccgggtatgtggtctgtggtggtggttctccctgtgattatggactgagatactcatttagtcctaataagaccagagaagtacattgtgagatacgtgggaaacggctgcatcactcactgtcttgtgcatgtgtctccccaggggcattttcagatttctgccacggaggggatgctcttcgcgaagggagagtcaggtacattggaggattcattgctgtgg

SEQ ID NO: 10539 - DNA, 188 bp, Homo sapiens
ctggcatcatctgagtcttggaatagctttcttgtttgttatctgcaaaaagctaggtggcctttttagtatcaaatttcaatcttggcctcactggaaccatgctctacagagctttcccaacagtttagcaagtaagcaaaatcagcttttgctcttcatatttcgtaggtgagactggggctttt

SEQ ID NO: 10540 - DNA, 233 bp, Homo sapiens
aaaatcattcattagcaaaatatccatcaaggtagaagctgaaatcatgttgccatctgctgtgaagatggctgcagttttgatacccttatcttcattttgtaggtcctgaaggaatgaaccaactgttgacaacattggtttgactacgaattgacaacgttcttttctagatggcaaggtaagtgttaccaagggaaggccatgtctataattaactgttatttcatcag

SEQ ID NO: 10541 - DNA, 519 bp, Homo sapiens
  misc_feature (1)...(519): n = g, a, c or t
aaataaagtggttacattcaaactttaacttccttagtaccatgctgcagatttcagcactgttaaggtattgcaagaatgcccaaccctctggtgtctgatcatgtatctagcaacattgcagtatgaagaaaagagatgccccggtctcagcccatggactagttaatacagtgaagcaggttcctgtcttttacccttcctgctcagaacataaaagattaaggactaaaatcaaggaaggctgggagttttagagctggcaaaatgaagtctaaaagataaatcaaggcaaacaattactgagaacttggctgttgcttaacctggcaagtctaaaagcctttctttaaccttgtaggaattagatgcataaggtttgctgcaacatgttcatggtaaacaaactaagtagagctcttatttacaaatcttgtaacaaatacttctggaggaaaaagagaaaagaattcactaagttccanaagacaaagctntaattgccagacgtatacaaac

SEQ ID NO: 10542 - DNA, 588 bp, Homo sapiens
aaattcagaaagatgagaagctacaatgcaactttttttttaatctacagataccgccaaaagaagaaatgtttatcagattttgaatgacatagctgtaagttggcggttggcagctttccacataaaatttcatcagaaagtgaaacttgattacagcccaaactagacaaggcaattcaggtgcccggaccccgaagtccacgtgagactacaggagaacgtgcattatggtgcttgccagccagtctcttgaggaactgcctgtaacggtcacggttgtggggagaaacaactccattttttttaagtttttttttttatggtattaaatataagtcttagcacctttggcatttttgtccaaacagacttcgacatatgaagtggggacataaccctcttcatcttcatttctccgaatgcgggtccagccatcgcctttgtcttcctctatgacatacaatgtttctccttcaactacggaaatcgttccttcattctgaccttcaaatgtgtagagagctttgcacgtccctatggcagggaggggctcctcatcatcaaactcgtcgtcaaaatccgtgg

SEQ ID NO: 10543 - DNA, 302 bp, Homo sapiens
ccaaaaactggagtgctgctggaaacgcgttctgccaggctgcacagccacaaccaaattgatgctggctggaaccagaggccagaaagcctggccttgtccccatgtgggagccctgtcctcagccctcttgtccccttgagctcagtgaattcccaccaggtgcccacagctcctggacttcaaattctatatattgagagagttggagagtatatcagagatatttttggaaaggagttggtctatgcaatgtcagtttggaatcttcttgaaagtttaatgtttttattaggagattt

SEQ ID NO: 10544 - DNA, 583 bp, Homo sapiens
ctgaattaagtcccttgagatacacagatgtggtttaacttagttataacatcttgtcatctagtggcgacaaagtccagcttatgccgctgtgagcctctatttgaatatttgttgcaaatgcttgtatgccctcatttacaagcgattttaattactctcatttaatggaaacaagtccccaggaaaagaaaaagaagaaaaatgatacagcaaaccatctgaagcaatccaagtcctatgcctacagtgacccaggtctactttgctcgaagagaacactggtactgcattcaaaccacaacagaatccgtcacttaactgacctctctgaattaaactgaggtatgaatcaatttgaggtatgaacagggaaggcaaaatgcaataccagattatgaaaataaccaaaatggaaaaatttgatgtagaagatatgtggcttggattgctccacatctttggttaaaacatattaagaaaagcctttaattacatctgtagtctgaagcattctaacagacaccagtattccagcaatcttcaaaagatctgtagtggcaggaaattaacgccataaaag

SEQ ID NO: 10545 - DNA, 375 bp, Homo sapiens
aaatgttctcatcagtttcttgccatgttgttaactatacaacctggctaaagatgaatatttttctactggtattttaatttttgacctaaatgtttaagcattcggaatgagaaaactatacagatttgagaaatgatgctaaatttataggagttttcagtaacttaaaaagctaacatgagagcatgccaaaatttgctaagtcttacaaagatcaagggctgtccgcaacagggaagaacagttttgaaaatttatgaactatcttatttttaggtaggttttgaaagctttttgtctaagtgaattcttatgccttggtcagagtaataactgaaggagttgcttatcttggctttcgagtctgagttt

SEQ ID NO: 10546 - DNA, 408 bp, Homo sapiens
  misc_feature (1)...(408): n = g, a, c or t
aaactgcaannatttttacttgctagagaatctgttttaatatagtggtttggcctctgattatttataggttttataaattttagaatcaatttctctttaaggtggctcagatttttcaactcttgtgcacataaaattgagttgaagttcattgtgcctttttttctttatccaaattttgagttaaagcttcatatggtaactgcatcctgttcggacactatagtctaaatttttgaaactgtgtggtgttcgctaaaagtaggaataacaacgtaaaagctaattaaggtcacaaacttcagtgaaacccttaaaagtccaaatcttcttgatattgtgaaccgtaccccttccagtttagtttcttctggactttccttacttaactgacagttacctttt

SEQ ID NO: 10547 - DNA, 332 bp, Homo sapiens
ctgtgcctcatcagggcagaggttttagtcagtatggtgtgagtggctcaccaacgaaatctaaagtcacaagttgtcctggctgtcgaaaaccacttcctcgatgtgcgctttgtctcattaatatgggaacaccagtttctagctgtcctggaggaaccaaatcagatgaaaaagtggacttgagcaaggacaaaaaattagcccaatttaacaactggtttacatggtgtcataattgcaggcacggtggacatgctggacatatgcttagttggttcagggaccatgcagagtgccctgtgtctgcatgcacgtgtaaatgtatgcag

SEQ ID NO: 10548 - DNA, 389 bp, Homo sapiens
  misc_feature (1)...(389): n = g, a, c or t
ctgatgaatgaataaacaaattgtggtatctccacacggcacaatagaatattcagccataaagagaaatgagggactgatacatgctaaagcatggatgagccttgagcgcatttttgccaagtgaaagaaggcagacacaaaaggcaacgtattgcatgagtgcatttatatgaaatatccaaaataggcaaatccatggagacagaaagcanataaatggttgtaagaagctganagaaaggagtggggagagatngctaaaaaggagtttccttctagggtgatgaaaatgttctggaactacttattggggatgattgcacaacatggtgaaggtactcaatgtcnctaatggtaaatttcacatacactttaccataattttt

SEQ ID NO: 10549 - DNA, 358 bp, Homo sapiens
aaatgaagtaacccctaaactcagccagtcccatgtttttttaacacttggaatatctaattccatttacactgcattcttcaaatgtaattttcaaagatgccttttgcctcatcccttgcttttaagtattattatagacttttggaaactcacgaaacaagcaatccctaaattctcgcccaggaaagtatcttggattaaatggtttttgagaaccttgagagtgtatattctatgaaatggaagaaacaagaactagacagagtcacaaatgctgttgatcacagacaatctctgccatccataaggtaaatgtaatacatctggcgacctgctgagtgtgaacttgcagcag

SEQ ID NO: 10550 - DNA, 298 bp, Homo sapiens
aaaacataaattaataatttccagtggattcccttaaaaagattacagcagggatttccagatcgaacccacccccacctctagagtttttggctgttttctaaagtcttgaattcaatgaggtgaaggaggaagaaagtgtttaggaagtcagtgggttccagaagagctggtgctgggtggggcagagtggtgagagatgctcctttcaaatggaaggctctggaacccgccaaaagggagtgcaagctggggcaatcttcctggacagccaccagagaaaggcgtcagaccccac

SEQ ID NO: 10551 - DNA, 530 bp, Homo sapiens
ccatgcagtgtgcgacagttcaggacgggtagggatgggtcccattctgtctgggtcaagggctctatcagcttcttccatgtgcctttgggaagaaatctcgttactttaagtttgctttcctgttatcttgatgaagtgcccattttagcagacacttgtagtgctgaccacttaggaaatgtacaaactcctaagcttctaaagggaggcatggcaaaaacgttggggtcaggatgtctctcacgctgctcatgttaatactattaacacatgatttgagaaataagttttctctaaaatgcatattttgccgccacacactgaacaatattatttccagtgaagtttgatgcctgttcttacgttgtgttcacctgttggttcaccactcagcagatctgattctgcaagaattaatggtagaactagatcatcctttctaacagacgagcctgtgtcctgtgacggcctttcacagcggaatgcagttgtacctcacattacttttgaaacttcactcgttccag

SEQ ID NO: 10552 - DNA, 274 bp, Homo sapiens
ccgaggctgtgcctagagagtggagatttttgatgaaaggtgtgctcgctctctgcgttctatcttctctctcctccttgttcctgcaaaccacaagataaaggtagtggtgtgtctcgaccccatcagcctctcacccactcccagacacacacaagtcctcaaaagtttcagctccgtgtgtgagatgtgcaggttttttctagggggtagggggagactaaaatcgaatataacttaaaatgaaagtatactttttataatttttcttttt

SEQ ID NO: 10553 - DNA, 363 bp, Homo sapiens
ctgaaagaggactaatgaatccactcgctgccttaggtccatagctcagtgaagcaatgaagtagtccaaattgttgctgaggaaggatgcaatctttcctgctccatttgttaatgccactactgatgacaggatacagtcattagttgttatcagcttctgtattgctgttggaagttcatgctctattgcagctttttgactataatgtttggaaatatctttcataacgtcatgaaatccatgcagagcagcaccaacatttgttaacacagaactgtagtttgtccgaaggagtccatctggctctgtacttgacaaggcaagaagagctatgtaagtctgcagcttctcaaacacag

SEQ ID NO: 10554 - DNA, 364 bp, Homo sapiens
ccatatgactcctggggccacctccacgacggcccagccccaccgacgctctgctgaaaatcctgcccctcagcaggacgcaagcttgttccccaaatagtggtgacctcaaactgcaatatgatgaaacctgcagccaacactgccctccacaagggtttctggaaaggctgaagctggagacggtaaaccacaacaccgtcccaggtcactccaggtcaccccagctaaagacattcaacaccagccaaaaggctaaagtttagtttgaagggttcaaaggcaaatacactgaaacccacgtgtaaacctgcctggttttcaaactggaagagaaacactttggtgtcttcaataacccagg

SEQ ID NO: 10555 - DNA, 509 bp, Homo sapiens
ccaaatctcttatccaatggaggtactgagtggctggatcagttaccatgcaagctcacgatgaatgagattgaatttggttctgtgtgcacactgggctctggggagggaggacacccctgtgtgttgctgctgccttccgtgctgtctactgtatccttcatgtgtctccaaatggtacacgccccatgggattacagaacacagctacagaattaggatctcatggtaacaatgaggaattaggttactgtagaactaaaatatgtttaatgaaattaaaatgcaatggaaaaaaaatcaggcaacagaacattctgatgaatttacaggactgattatatcccacggcactgaatgacaaacagttcttctccatacagtcgcaattagaggcatagaagtcatactgaatgctgaatagaagaacactgagaagagcaggttataaatgaaggttttcacattaaacagaaaaatagacaaaatcatcggtaagaagctagctt

SEQ ID NO: 10556 - DNA, 334 bp, Homo sapiens
aaacagcaccagcacttctggctggtttgaaccttaaatgccaccacccaccagagaggaggctctcactagattctaaatctgttatttaattacttttcaattgaaaaacaaaacagacagaagaaacttattagaataaggccacctaggaatgttcttaacttttccattcagcttttggctgatatatgaaaatacaaataaatacatcctttccccaggtgcaaggctaaaccagcagctccaagggcttggtctacagtgctcagaaagacacactgccttaaaagtcaggctagtgccctagctccggtggcctctgcaaatgagg

SEQ ID NO: 10557 - DNA, 546 bp, Homo sapiens
  misc_feature (1)...(546): n = g, a, c or t
ctgttctcccttgaggacctggtcaggatcaagaaagggctgctggcacccttactcaaggacattctgaaagcttcccttgcacatgtggctggctgtgagctgtgtcaaggaaagggctttatttgtgaattttgccagaatacgactgtcatcttcccatttcagacagcaacatgtagaagatgttcagcgtgcagggcttgctttcacaaacagtgcttccagtcctccgagtgcccccggtgtgcgaggatcacagcgaggagaaaacttctggaaagtgtggcctctgcagcaacatgatgcccctgagtactgtgaaaaagactgttcaacatgccttatgataacaccgatttgtgtctattattggtgacattgttttagatattgggtattgtatattaaggaaaaagatggtctatattctctttattgcatatacttaatgtttcaaaagaatgcagattctgtgtttaagcacagggctgatagttgtggttttgtttacnaatgttctgttttggctgctattggtttttt

SEQ ID NO: 10558 - DNA, 499 bp, Homo sapiens
ggccgactcgcaagatggcgccgcagaaagacaggaagcccaagaggtcaacctggaggtttaatttggaccttactcatccagtagaagatggaatttttgattctggaaattttgagcaatttctacgggagaaggttaaagtcaatggcaaaactggaaatctcgggaatgttgttcacattgaacgcttcaagaataaaatcacagttgtttctgagaaacagttctctaaaaggtatttgaaataccttaccaagaaataccttaagaagaacaatcttcgtgattggcttcgagtggttgcatctgacaaggagacctacgaacttcgttacttccagattagtcaagatgaagatgaatcagagtcggaggactaggcaaaggctccccttacagggctttgcttattaataaaataaatgaagtatacatgagaaataccaagaaattggcttttagtttatcagtgaataaaaaatattatactctcgaa

SEQ ID NO: 10559 - DNA, 455 bp, Homo sapiens
ctgtcaccattctcacgtgattcttgtgagactctttttggttataattactatttaatatttagactattttactgagcagactttataaatgagatatctacaaggcacttaaagtgttacagatgttttaccttaagaattatttaagttgtgttgggttaagacagttttcagtgtaccgtaaatgttgtgttttcagaaaaagacaaaacgatggtgctgactggttttctgtatattgcacaacagtcctcaaatacactgatgtatgaaactattcatacatcaagcagcatttttttcactctccttagaattggaactatgcagttaaggcagataaaatgtacagatgtttcatatattacaggttacatatataaatcaaaatttcctatataaaactgatttgggatttggggtggaaatattttgaatattaatttattttt

SEQ ID NO: 10560 - DNA, 476 bp, Homo sapiens
ccacagcatccccacgttctgagaagtacttggaaatggttgtctggaaagcttccactttggtcttgacggcattcaccctctccagcaccttctcctggattgctaccccaaaatcatttccatcttcaatcttggggatcaggtgttggatccatgtaatcaccagaatgcatttctctttgagagtccagacttctggcttaaccagggcaagcagggacaggactttctcattcccagggagaaatccacacttagggacttctttcttctcctgcttatctgtttccatctcatcatccttgggtggagggtctgggatggggatgtccagtggggcccggagggaagtcaagtcagccacattgagggagtcctcttgcaagagctgattcaggtatatgattttctgtggcaagaatctgtagaggaattcctcagcctcctggaaaagattctgcctgaagtcctcc

SEQ ID NO: 10561 - DNA, 729 bp, Homo sapiens
  misc_feature (1)...(729): n = g, a, c or t
aaaatgcattttcccttgtcctgtctttaactagatatacatgcttatatttatagtgggtttcacagactataaaattgaatgtatgaaatttttatttatatcagtgcttttaataatgaagatatttttggagtaatggtgctgtcttgtagcgagttattaatcatagtaagatttttttctcttcatttgctttttttgtttcatattaacaattttttttttacacggacacaaccctctgacagtctttccaaatattaaaatcatttgaatatgtatgctgtgatctgaacactgctcaagccatcaagcagtcttcatacagtttgcattataaaatctcattaaattctccaagaaaaaataagttgaagaattttatttcctgaccatgcatcccctggatttctgagtttcagttcagattgtagatgacaatataagctgccttccgaaattgtcaacatctgaatgttaagtccattttccccatggaagaagcccgtagttccatgaagtatggattaccatttgtatttttcactaacagtaaatgtatttttcttattaattgtttgccttaggaatgatgaattacattttttgttccttcttaccataaacatctgcattcctcagctcagccttccttgtatgttgtttctttataaatggttgagctgctgatgcaggtattcccaagctancagtacaaatcatttt

SEQ ID NO: 10562 - DNA, 384 bp, Homo sapiens
  misc_feature (1)...(384): n = g, a, c or t
aaaatattttaatcaggcagagttttatggatagagaatagaagagaaaggtagtaaatattgaacatattccaatataggaacctatctctgttttagtacaaaatatttctgacatctgaactagaggtcaagagaataaattcatttgtatacatctgagcaacctgtctttcagatgataaagtatctagccttttctgacaccataatagttcattttgtagggaataagccattaggtgtatataattgctttctagaaatgacctaatgtccccaaccactttgtagtggcagatcactgtttcacagcatattttctcccaaggaaagtattcaaaagagactgcaactaacannactcttatttcatcaaaattt

SEQ ID NO: 10563 - DNA, 377 bp, Homo sapiens
aaaagagcaaaatgtttattttttatatatcttcttagatgcctataaaactacaaagaaaattaccctattccactgaaaaggagagcagagaataaattaaacctttctactatatgtgcctttttttcaactatgctaacttaatgctgtacatgtaatttcacttttcagattaacattgacagttcgacaagagagactatcatcaggaacattcaggaacccactgaaacatgttttgaagaagctcagaaaatagtctatatgcatatggaaagggattcctaccccagatttctaaagtcagaaatgtaccaaaaacttttgaaaactatgcagtccaacaacagtttctgactacaactcaaaagttt

SEQ ID NO: 10564 - DNA, 467 bp, Homo sapiens
  misc_feature (1)...(467): n = g, a, c or t
aaaagtattttctctacagagaatcttatcagctatacaaaaatntgtacagtttttatactgaagctagtattgagctgcacttgaattcacattcttagcaaaataattgcctgagcacacacacacattccacacgcatcattaaaggatagccatttattcttcatcttcatcctcttcctcctcatcttcatcttcttcttcctcctcctcctcctcatcttctggttcgttcttcttctttgagcctgttggcctgccagggcccttctttcctgcttcacttttgcccttggcacgatatgcagcaatatccttttcatatttctcctttagcttagctgctttctgttcatatggntgtttatctttggctgactgctcagaccacatttcacccaatttctttgcagtatccccaatggataggccagggtgttcacttttgatctttgggcgatgtt

SEQ ID NO: 10565 - DNA, 350 bp, Homo sapiens
  misc_feature (1)...(350): n = g, a, c or t
aaagaacagagttctggagtaaagaagcaggttcccttttcagtagacacctcccgtctgctgttggaacacatcaattgtatcttcatcctccatttccaactgtgcaggtgtgtctgtttcattgattggttgcccgtcaaatcggaatntgatctgcctcattgacaatccctgtcgttcacaataggccttcattagtttactaagtggtgtatgcctcttaatcttaaactgcaccacagaaccatcctgccccgccaccttcaaattaatatgatcgttgttctcagtcttgactctttccttgggcttttcgtcggccatggcgagcgccggagtctcctcag

SEQ ID NO: 10566 - DNA, 270 bp, Homo sapiens
ctgaagctgcaggtgctgatcgagtcaaagagccctgacatagccatgctttttgaagaagcctttgtgcacctgaaaccccaggtttgtctgccattgtggatttcctgggcagagtggagtgaaggtgccaaaagccaagaagacactgaggcagtctttaagaaagctctcttagctgtcataggtgccgactcagtaaccctgaagaataagtacctggattgggcttatcgaagtggtggctacaaaaaggccagagctgtgttt

SEQ ID NO: 10567 - DNA, 465 bp, Homo sapiens
ctgcctataaaactagacttctgacgctgggctccagcttcattctcacaggtcatcatcctcatccgggagagcagttgtctgagcaacctctaagtcgtgctcatactgtactgccaaagctgggtccatgacaacttctggtggggcgagagcaggcatggcaacaaattccaagttagggtctccaatgagcttcctagcaagccagaggaagggcttttcaaagttgtagttacttttggcagaaatgtcgtagtactgaagattcttctttcggtggaagacaatggatttcgccttcactttcctgtccttaatatccactttgttgccacacaacacaatggggatgttttcacacactcgtaccagatctctatgccagttaggcacattcttgtaagtaactctcgatgttacatcaaacattatgatggcacactgggcttggatataatagcc

SEQ ID NO: 10568 - DNA, 678 bp, Homo sapiens
ccttgatgataccattatcctcattatagatgatgcacgggcccctgcgctggatacggcgacggtttctcattttgcctttgccagctctcattcgctgagaggcatagacctacaaagtgagcagttttagtattctgattaagatagaatctctgcaatagatcttcagagttttaattcctttttacagatgattaaactgggcacaataacttgccaaggttacacagagccataaacagcagttaggattcaaacccaagtaatcgggctctgaggttcttgttctctcacacattaaggcttagctatactgcccttatcttctgaaattcaaagtgacaaactgtgaacaaggagtaccaaactgtaaatgtgctcattgaacggacctttttgatatcattccaggctttaagtttcttaaggagcaaaacagcttccttggtcttcttgtagccttcaactttatcttcaactaccaaaggaagttcaggaacttcctcaatacgatgacctttagacatgaccagtgctggtagggctgaggcagccagggcagaacagatggcgtatcgtttttgggttgtgttcactcyacgatgccaacggcgccaggttttggttggtgcaaacattcggcctccacgacacatgtttccaaaagcaccctgg

SEQ ID NO: 10569 - DNA, 471 bp, Homo sapiens
cgccaatcttcgctctgaggtgctgtctcaccggtgagacctggaagcgggcgagtctcgtgctgtgtcggacctgcagcccctggccttccgccaccatggagtacctcatcggtatccaaggccccgactatgttcttgtcgcctccgaccgggtggccgccagcaatattgtccagatgaaggacgatcatgacaagatgtttaagatgagtgaaaagatattactcctgtgtgttggagaggctggagacactgtacagtttgcagaatatattcagaaaaacgtgcaactttataagatgcgaaatggatatgaattgtctcccacggcagcagctaacttcacacgccgaaacctggctgactgtcttcggagtcggaccccatatcatgtgaacctcctcctggctggctatgatgagcatgaagggccagcgctgtattacatggactacctggcagccttgg

SEQ ID NO: 10570 - DNA, 411 bp, Homo sapiens
ccacatatgcccctgtcatctctgctgagaaagcctaccatgaacagcttactgtagcagagatcaccaatgcttgctttgagccagccaaccagatggtgaaatgtgaccctcgccatggtaaatacatggcttgctgcctgttataccgtggtgacgtggttcccaaagatgtcaatgctgccattgccaccatcaaaaccaagcgtaccatccagtttgtggattggtgccccactggcttcaaggttggcattaattaccagcctcccactgtggtgcctggcggagacctggaaatgttcatgaatgtttgaaaggaacaaaattatcagggatggctctttgccatgggtcttattttcaccctcttttctgtaagaaaaaagaacaatgtcttaatgtattttt

SEQ ID NO: 10571 - DNA, 303 bp, Homo sapiens
tttttttttccaagtaagcgtctatgcaggcatcacaaactttggcggatacagtagatatgtatttctttgatgctgaaaggtcagtccctaagacaaaatcaaatgtctcaaagaattaaaagcaaaatgcatgtgtcttcctggcaaaggtttccatttgcaatgtaatctgcatttctacaaatactcaatgtccaaggccactagagggtgaaaaaccagggcagcgtcttccagcaggggtcagggcagacccagagccaaaactccatcctcagcccaaccttggaggcccagcag

SEQ ID NO: 10572 - DNA, 582 bp, Homo sapiens
aaattgatctggtgttccttgcggggcttcaattgcatctaaataratgtgagagttgaaagacccataaggggcttctctcgctttacgatgtcttattatttttttttccttcctctggttgatgaaatgccagggtgaaagggatagccaaataggctaaagcacaagtgccactctagttattcsgcagagtgcccaataaaggtccacgacaataccatcacacatccgctcggggatgaacaagggctgactgactgataagytcttgaaaattcttaagctcactgcatcccttcaggtctccaaggaatgctaagtctcctccctgccatgagagacatgaaatgaacttagtgttgggagacggaagctggacggccctcaggggctgacccgcagggactttgggatatagcagagagagcttggcatgacttattactccaagctgtagaaacctggaaaatagctaccctgcagcccatgcctggtcaactggaggaccaccttagtggaagggggacaatcagggcctctggcctgccatgtgcacaagcataacaattgcatttgttt

SEQ ID NO: 10573 - DNA, 339 bp, Homo sapiens
aaagaacagagttctggagtaaagaagcaggttcccttttcagtagacacctcccgtctgctgttggaacacatcaattgtatcttcatcctccatttccaactgtgcaggtgtgtctgtttcattgattggttgcccgtcaaatcggaatctgatctgcctcattgacaatccctgtcgttcacaataggctttcattagtttactaagtggtgtatgcctcttaatcttaaactgcaccacagaaccatcctgccccgccaccttcaaattaatatgatcgttgttctcagtcttgactccttccttgggcttttcgtcggccatggcgagcgccgg

SEQ ID NO: 10574 - DNA, 202 bp, Homo sapiens
aaatcaataagtaatctaggactagcattatgtttgctagacctggcatttgctcggtacataaggttcaaagtttcctttcctttttttatttattttatattttgcaatgttttttttccataatatttaagtttttcgatgtttagatatttttcttcggtgaagcacaagtttcttttcatggtccctgatcaatttt

SEQ ID NO: 10575 - DNA, 305 bp, Homo sapiens
ctgagaattcgtccgctcccgaggctgagcagggcggggctgagtaaatgccggcttaccatctctaccatcatccggtttagtcatccaacaagaagaaatatgaaattccagcaataagaaatgaacaaaagattggagctgaagacctaaagtgcttgctttttgcccgttgaccagataaatagaactatctgcattatctatgcagcatggggtttttattatttttacctaaagacgtctctttttggtaataacaaacgtgttttttaaaaaagcctggtttttctcaatacgccttt

SEQ ID NO: 10576 - DNA, 231 bp, Homo sapiens
gagacaatggccccgatgttatggagcccgaaggcgtcatcgagagtaactggaatgagattgttgacagctttgatgacatgaacctctcggagtcccttctccgtggcatctacgcctatggctttgagaagccctctgccatccagsagcgagccattctaccttgtatcaagggttatgatgtgattgctcaagcccaatctgggactgggaaaacggccacatttg

SEQ ID NO: 10577 - DNA, 453 bp, Homo sapiens
cctgcagcatgggaggtaccacgctggcagtcagcagtcacaccagggtggtcagagacactggtggcagcatctgtgcttgcaactgcattcccagggtgtctgttttgttcccaagtgtctcccacaaaattccccaggaggttctccgattaaatgtcctcagggtgaaaagcatggacaccaaatcactccgtatccacttccatgagatgtcttgatgctccagttcaatgagtaacaatttctcaagaggctctgattagttcattaaaaaataagcacccccacctcattccccgtgatacagcacatctagtaatctaggcgcctcagctaagctgcatagctcttagcacacaggacaggtcagcgttcacacatcaacactataactatgcggcggaactagctccccgctagccgtcaactactcaggagactacctgtgag

SEQ ID NO: 10578 - DNA, 430 bp, Homo sapiens
aaaacgggggggaacggggaaacgagctgtatctatggttcacctcattcaacttccttgagttatggcactatgatgttgcttaattaggtaagacatggatatttgcaccgagtgcaaatactgttcataacaaggtcatagctagaaagacagatgggctcaagtgtggacaaataatgtcatcaaggtaatagatcaaaaatattaaagccctataaaagatctgagcagtcaactccaaaacatccacatgacaaagtccttaaaatacaaatctcattactcttactcatgcaactgctaaaaaatagtgtgcagatatgtatttatatttgccttaaccttcaaaatctagggacataaatcttgctttgttaaaaaaaaataaaaaataaaaatagacaggaatttgctacacttttccttc

SEQ ID NO: 10579 - DNA, 342 bp, Homo sapiens
  misc_feature (1)...(342): n = g, a, c or t
ctgctgcccctnagtnttctttccttctccttttcttttcctttcttctctcttgtgcattcttcaggtcagtcatcacattcaaagtcttccatacccacataaccacaatgatcatggcattcaccagcagtggggctgaaaatactatagaaatgaacatccccctggagtccgaaatactggtatttcgaaaataatctccagttcatcgcagccgcctcattgatgtattcagcacagtagactaagatgactagacacagaaagngccccgatctgtacnctgtagctncgggaggacaagcaggngaggagcacgcagagccgcgtggaaggngg

SEQ ID NO: 10580 - DNA, 653 bp, Homo sapiens
  misc_feature (1)...(653): n = g, a, c or t
tttttccgcccatgttagcattgaagttgtgagctctacttgcttgtctttatggccctttaattcaagtaattggtcagtatccgtatgggtcttttataccacccgctgggggctaaactaatttagctgctgctgtatacttactaacaaggaataaatgttaagctttcttctcagtattgatggatggtatctaaaagtatttttatgtttctttaacatggcttaaattttgaacttaatgtatcaagttagtatggtcatattaatacctgtgcttttcagattcttcaaacacctaaatgaaagtgataaattcaaaactgatccttttagttcctcattatatgatatgaagggattaactgtagcaggatagtcaacctgaccgtacggcatggtgctttttttcaggataaatcttcagacaaaaaagtgcaaacaaaagggaaaaggggagcaaagggaaaacaggccgaagtggctaaccaagaaactaaagaagacttacctgcggaaaacggggaaacgaagactgaggagagtccagcctctgatgaagcaggagagaaagaagccaagtctgattaataaccatataccatgtcttatcagtggtccctgtctcccttcttgtacaatccaganga

SEQ ID NO: 10581 - DNA, 278 bp, Homo sapiens
  misc_feature (1)...(278): n = g, a, c or t
ccttcaacagactggatggggtccacccacattagggtggagtttgttctgccactgtgcagttatcattctgggatgggggtaccttactctcccaatgagaaattctaaatttcctcttttgagcctggtgcctccaccttctcanaactgcatagggcgtgagctttgttggtgatgtgacctccagaacagactgtgagcagatttttttctttaatcctgagcctatgcttgctgctgtccttcttgactttcaactaggcctaaaaaagcgn

SEQ ID NO: 10582 - DNA, 523 bp, Homo sapiens
ccagggttaggacattcaaatgtctttatccacattcctgaaggataattgttatagattccctacctccataggaatgcttataatggattatctatacaatctccacattcccacattttgcattagagaatggaatcagtcaaaccctgttcccagagtttcccttagagttctcacctgttgtcttatatccatctaggaatccccatctctaatgtaagcttggagatccgggcccccgggggacaggtgactgaaggacaaaaactgatcctgctctgctcagtggctgggggtacaggaaatgtcacattctcctggtacagagaggccacaggaaccagtatgggaaagaaaacccagcgttccctgtcagcagagctggagatcccagctgtgaaagagagtgatgccggcaaatattactgtagagctgacaacggccatgtgcctatccagagcaaggtggtgaatatccctgtgagaagacctgatggctatagaagagacctcatgacag

SEQ ID NO: 10583 - DNA, 505 bp, Homo sapiens
  misc_feature (1)...(505): n = g, a, c or t
ccacattgggaattctgcacacaggtgcctgctccaccanncagagaggctcaggagattgtccagggacaaggagacctggccggacctctgcagggaggtgaggcccctgcccccatcttgtcccatcacattctggatgtttggcatccccaggctcctgggaggggagaagtgctgataaaaaggccaaaaatcacacagaaagaagacagaaaactccacgcacttcctacataggtgctaccgtattcctacgagcacggggcctgtgttgaagactccctctggaagttacagaaggaagccaccaagagttcagcctcacagcctctttctcagatgcagtcaccactttaccaaacttggcacatccaaccactcctttcataattttacacctgtttgtggcctggctgacagatattttgtnattgatctttctaatttcagggattctaaatgtgttttgagaatctggtcagcactcanggattctgtcttt

SEQ ID NO: 10584 - DNA, 240 bp, Homo sapiens
  misc_feature (1)...(240): n = g, a, c or t
ctgctgctaaatacctntgagaaactctgcttctatctaaggggacctacttttntcnggaatctcaatacttggaacaagaacctcctanacggaccctttggcataatgaattggaccaactgtaggttccaggactagagagccagcaatgcctccatgaacaatctcacccaattactctgctcaggaaacgaggtaactgatggacagccgaggcagccccttaggcggcttagg

SEQ ID NO: 10585 - DNA, 666 bp, Homo sapiens
  misc_feature (1)...(666): n = g, a, c or t
aaaanaccaatagcagccaaaacagaacatttgtaaacaaaaccacaactatcagccctgtgcttaaacacagaatctgcattcttttgaaacattaagtatatgcaataaagagaatatagaccatctttttccttaatatacaatacccaatatctaaaacaatgtcaccaataatagacacaaatcggtgttatcataaggcatgttgaacagtctttttcacagtactcaggggcatcatggggctgcagaggccacactttccagaagttttctcctcgctgtgatcctcgcacaccgggggcactcggaggactggaagcactgtttgtgaaagcaagccctgcacgctgaacatcttctacatgttgctgtctgaaatgggaagatgacagtcgtattctggcaaaattcacaaataaagccctttccttgacacagctcacagccagccacatgtgcaagggaagcttgnagaatgtccttgagtaagggtgccagcagccctttcttgatcctgaccaggtcctcaagggagaacaggtggagctcatcagtcaagtgtcccggccctgccctacaaactcctttaatgcactgttagcaaacctacaggtcttcaacagcttcttgatatggaagagctgctcctgaatttccttc

SEQ ID NO: 10586 - DNA, 443 bp, Homo sapiens
  misc_feature (1)...(443): n = g, a, c or t
ccaaaaacttcagcataaaaactatcctgtctgtgtattatatatatttattacnnnatttaataaacaaaaaccacttttgaaccaggtaattttatctagtgtgaaaagaaattaatcacatggtcatatactggctagtgctctctaaaagtagacattaaaatatttcataattggagggaatctttggagattagtggcatctaatcttggggcctcagacacccaaaatctatatattgaccagtggaagttgatgatttgttatcaaatttcaaagcacctaatggaaaccccacttcatctctgtgaagattttcagtncctttacagttatttgaaattatttcaattctgtggagccacttcagaaactccaatgggcctttgcaatattaaaatgtggagaatgcattaatcattatttaatcaatgagttt

SEQ ID NO: 10587 - DNA, 631 bp, Homo sapiens
cctctccacaggctgcttgagtgtcctcatgacacaacagttggcttactccagagtgagcaactcaagagagagcaaggcagaagctaccaaatctttatgtttgaagtcatgcaccatcttttccacgagtatcctgttgattattttgatcagcttgttcagtctgggagggaattgcacaagggcatgaatactccactggcaaggatcattgggggccatcttggaagctgtgtgaatgagcaaatgaatgcacagatagaatattagcagtgacaatgatgctagaggtcacctaccccactgtcctcttgtccttctcccccaaccctcccctgctcccaggcaagaagccctctagcctctgcttgatcactttcagcactcaacatcttcagggaacctattccgccgtgggacagtgttaattagtggaaaactctttttcaaaagttgaaatcagttcctctgtgtctattacctgctgatcactgtccagacttctggaggacacagagcaagttttattcctcttactgatggtagcctttcagatccatcccttccctccagtatattagagttacgtaaattcttaaaatgcttagcagctcatttatcctgaaca

SEQ ID NO: 10588 - DNA, 510 bp, Homo sapiens
  misc_feature (1)...(510): n = g, a, c or t
aaagacatgaaaaatatcccaagatcatactagatcataatagcaattcctttacaaatgaattatggaggtaactgatctctaacagtttccttcatgttgttttaatgcacaagggcagaggatctgccgacccttggaaccagcgtgagctaaccacgtgctatagacacttcatggtgtcgtacccagggaagtcaaagcgctttgctccctcactgtctgtgagtcctcagccattagtagcccaccccccgctgctccaaaacttgagttgtttcaaatgtttctcactgttcatctctncactgaccccactccagaaagcctggagagaggccaagatgccacccaccttccccaatccctcgccacagatctgtgtctatcacacactctgtaagtgccgctttgcttcttcctctcttgaaaagactgagaacacacattttaacatgttangaaaatggggcaggctaaaaaatgactgatcccaccgccagtgactca

SEQ ID NO: 10589 - DNA, 401 bp, Homo sapiens
  misc_feature (1)...(401): n = g, a, c or t
ttgaatgctctattttgcnntaannntttattnactagtctcagtaatacattagtaaaaancatgtcncttaattaattgggttanaatcaaanaaacatanagtngggcaatatacttnatcctacccatcccacccaaatcttactctactcatntcattctcattaattttgggaaancatnanaanatgggttcgttgagtaananattaaaanaaataagctttttgatccctgccaacaccccatgcccaggggggncaccctccaatacaataacatgccaggaanagtaagntgccctttctgangccgnaatctgccatcatnttcccatnttccagnctntttccattgcnagncacaatctgggtctcagggatnatacccggtcttag

SEQ ID NO: 10590 - DNA, 135 bp, Homo sapiens; identical to SEQ ID NO: 322

SEQ ID NO: 10591 - DNA, 420 bp, Homo sapiens; identical to SEQ ID NO: 364

SEQ ID NO: 10592 - DNA, 306 bp, Homo sapiens; identical to SEQ ID NO: 484

SEQ ID NO: 10593 - DNA, 404 bp, Homo sapiens
gctggagcttcactgtgagtccctgagaggctccttcccgatcctgtactggttttatcacgaggatgacaccttggggaacatctcggcccactctggaggaggggcatccttcaacctctctctgactacagaacattctggaaactactcatgtgaggcttgacaatggcctgggggcccagcacagtaaagtggtgacactcaatgttacaggaacttccaggaacagaacaggccttaccrctgcgggaatcacggggctggtgstcarcatcytcgtccttgywgctgctgctgctctgctgcattacgccagggcccgaaggaaaccaggaggactttctgccactggaacatctagtcacagtcctagtgagtgtcaggagccttcctcgtccagg

SEQ ID NO: 10594 - DNA, 639 bp, Homo sapiens
ctgggcatcaccaagtcacagtttccagcgtgctgctcagccctccgagtgtgtgtgctcatccttttcatagaagtcccatcggccatggagagggttgggctgcagagctgtgattgccagaggcccttccttgagaactgtggggaaggaggccctgggggtttcttctgtaggcagagctcaggccccagtcacctctgccaccctcagcctggcactgttgtgccagagcctctgctgcctctctcttcctacccatctgcagaccagcagaatattctccccctctcatcaccaaccaggagtttggtgtggtttctggacacggccagagcaggtcactgcggggctggttttgctgggcttccctgtcaaagcaatgctaacgtccagctctcgactcaaggccaggttcttctcccacttgtggcctcttgggcttggaggctgagccaggggctcctctcctgctggccgtccaggaacaggacatcttcacatcctcagtcttccaaacccggaccatgccgtcttgactcccggtgatgatgatctggcttgtgtcccatgctgggccctccatcaggcagcaacaggttatggctccttctgggccccaggctgtggtgatgctgg

SEQ ID NO: 10595 - DNA, 581 bp, Homo sapiens
ctgtctccactgtggagttactatttttccttttccccattttattcatcagaagccagtcactaagcgaggtcaaactccaggacaggggaattaagtgccaccttctggagagggagcattcacatttattacttgggatccttctgtaaggaagagctgtttctcctctaaaaaactctttaatccttttaagcctcaatttcttaattgtgaaatggggctaatacctgtatccaaccaagggagtagttagaaggtaacatgataggtggaaagcacttaacataggcaaaatgttattatcaggaatgatcgagagacccatccaactatctgaaggagtcacttaactctactgtactgcaagcgctgtaaagtcttgcatctttcactgggggtaaaggcccccagtccctgagacgggccagtttggaagacaggctggttttttctctgttctcctgagagcccttcagatgagaagggaggtctggagacagaatgccaaaagcccattaaaggcacggccttgcatttcagagagggagcaggtctagagaagaaccagaggagctcag

SEQ ID NO: 10596 - DNA, 256 bp, Homo sapiens
ctggyctgtgggtgatcccagctcttactaggagagggaastgaaggtcytggtgccaggggcccaggccctccaaccataaacagtccaggatggaacctggttcacccttcataccagctccaagccccakaccatgggagctgtctgggatgttgatccttgagaacttggccctgtgctttagacccaaggacccgattcctgggctaggaaagagagaacaagcaagccggggctacctgcccccaggtgg

SEQ ID NO: 10597 - DNA, 2154 bp, Homo sapiens
gatgcaaggagatgagacagttaaatttacttcctcttttctaatctgagaggtttcatgttgaagaaaatcagtgttggggttgcaggagacctaaacacagtcaccatgaagctgggctgtgtcctcatggcctgggccctctacctttcccttggtgtgctctgggtggcccagatgctactggctgccagttttgagacgctgcagtgtgagggacctgtctgcactgaggagagcagctgccacacggaggatgacttgactgatgcaagggaagctggcttccaggtcaaggcctacactttcagtgaacccttccacctgattgtgtcctatgactggctgatcctccaaggtccagccaagccagtttttgaaggggacctgctggttctgcgctgccaggcctggcaagactggccactgactcaggtgaccttctaccgagatggctcagctctgggtccccccgggcctaacagggaattctccatcaccgtggtacaaaaggcagacagcgggcactaccactgcagtggcatcttccagagccctggtcctgggatcccagaaacagcatctgttgtggctatcacagtccaagaactgtttccagcgccaattctcagagctgtaccctcagctgaaccccaagcaggaagccccatgaccctgagttgtcagacaaagttgcccctgcagaggtcagctgcccgcctcctcttctccttctacaaggatggaaggatagtgcaaagcagggggctctcctcagaattccagatccccacagcttcagaagatcactccgggtcatactggtgtgaggcagccactgaggacaaccaagtttggaaacagagcccccagctagagatcagagtgcagggtgcttccagctctgctgcacctcccacattgaatccagctcctcagaaatcagctgctccaggaactgctcctgaggaggcccctgggcctctgcctccgccgccaaccccatcttctgaggatccaggcttttcttctcctctggggatgccagatcctcatctgtatcaccagatgggccttcttctcaaacacatgcaggatgtgagagtcctcctcggtcacctgctcatggagttgagggaattatctggccaccggaagcctgggaccacaaaggctactgctgaatagaagtaaacagttcatccatgatctcacttaaccaccccaataaatctgattctttattttctcttcctgtcctgcacatatgcataagtacttttacaagttgtcccagtgttttgttagaataatgtagttaggtgagtgtaaataaatttatataaagtgagaattagagtttagctataattgtgtattctctcttaacacaacagaattctgctgtctagatcaggaatttctatctgttatatcgaccagaatgttgtgatttaaagagaactaatggaagtggattgaatacagcagtctcaactgggggcaattttgccccccagaggacattgggcaatgtttggagacattttggtcattatacttggggggttgggggatggtgggatgtgtgtgctactggcatccagtaaatagaagccaggggtgccgctaaacatcctataatgcacagggcagtaccccacaacgaaaaataatctggcccaaaatgtcagttgtactgagtttgagaaaccccagcctaatgaaaccctaggtgttgggctctggaatgggactttgtcccttctaattattatctctttccagcctcattcagctattcttactgacataccagtctttagctggtgctatggtctgttctttagttctagtttgtatcccctcaaaagccattatgttgaaatcctaatccccaaggtgatggcattaagaagtgggcctttgggaagtgattagatcaggagtgcagagccctcatgattaggattagtgcccttatttaaaaaggccccagagagctaactcacccttccaccatatgaggacgtggcaagaagatgacatgtatgagaaccaaaaaacagctgtcgccaaacaccgactctgtcgttgccttgatcttgaacttccagcctccagaactatgagaaataaaattctgttgtttgt

SEQ ID NO: 10598 - protein, 359 aa, Homo sapiens
MKLGCVLMAWALYLSLGVLWVAQMLLAASFETLQCEGPVCTEESSCHTEDDLTDAREAGFQVKAYTFSEPFHLIVSYDWLILQGPAKPVFEGDLLVLRCQAWQDWPLTQVTFYRDGSALGPPGPNREFSITVVQKADSGHYHCSGIFQSPGPGIPETASVVAITVQELFPAPILRAVPSAEPQAGSPMTLSCQTKLPLQRSAARLLFSFYKDGRIVQSRGLSSEFQIPTASEDHSGSYWCEAATEDNQVWKQSPQLEIRVQGASSSAAPPTLNPAPQKSAAPGTAPEEAPGPLPPPPTPSSEDPGFSSPLGMPDPHLYHQMGLLLKHMQDVRVLLGHLLMELRELSGHRKPGTTKATAE

SEQ ID NO: 10599 - protein, 9 aa, Artificial Sequence
  Ly1464 MHC HLA A1 binding peptide
ATEDNQVWK

SEQ ID NO: 10600 - protein, 9 aa, Artificial Sequence
  Ly1464 MHC HLA A1 binding peptide
ASEDHSGSY

SEQ ID NO: 10601 - protein, 9 aa, Artificial Sequence
  Ly1464 MHC HLA A1 binding peptide
FSEPFHLIV

SEQ ID NO: 10602 - protein, 9 aa, Artificial Sequence
  Ly1464 MHC HLA A1 binding peptide
LTDAREAGF

SEQ ID NO: 10603 - protein, 9 aa, Artificial Sequence
  Ly1464 MHC HLA A1 binding peptide
SSEDPGFSS

SEQ ID NO: 10604 - protein, 9 aa, Artificial Sequence
  Ly1464 MHC HLA A1 binding peptide
ELFPAPILR

SEQ ID NO: 10605 - protein, 9 aa, Artificial Sequence
  Ly1464 MHC HLA A1 binding peptide
SSEFQIPTA

SEQ ID NO: 10606 - protein, 9 aa, Artificial Sequence
  Ly1464 MHC HLA A1 binding peptide
MPDPHLYHQ

SEQ ID NO: 10607 - protein, 9 aa, Artificial Sequence
  Ly1464 MHC HLA A1 binding peptide
LMELRELSG

SEQ ID NO: 10608 - protein, 9 aa, Artificial Sequence
  Ly1464 MHC HLA A1 binding peptide
HTEDDLTDA

SEQ ID NO: 10609 - protein, 9 aa, Artificial Sequence
  Ly1464 MHC HLA A1 binding peptide
CTEESSCHT

SEQ ID NO: 10610 - protein, 9 aa, Artificial Sequence
  Ly1464 MHC HLA A1 binding peptide
ALGPPGPNR

SEQ ID NO: 10611 - protein, 9 aa, Artificial Sequence
  Ly1464 MHC HLA A1 binding peptide
LGMPDPHLY

SEQ ID NO: 10612 - protein, 9 aa, Artificial Sequence
  Ly1464 MHC HLA A1 binding peptide
CVLMAWALY

SEQ ID NO: 10613 - protein, 9 aa, Artificial Sequence
  Ly1464 MHC HLA A1 binding peptide
KADSGHYHC

SEQ ID NO: 10614 - protein, 9 aa, Artificial Sequence
  Ly1464 MHC HLA A1 binding peptide
LRELSGHRK

SEQ ID NO: 10615 - protein, 9 aa, Artificial Sequence
  Ly1464 MHC HLA A1 binding peptide
QLEIRVQGA

SEQ ID NO: 10616 - protein, 9 aa, Artificial Sequence
  Ly1464 MHC HLA A1 binding peptide
WCEAATEDN

SEQ ID NO: 10617 - protein, 9 aa, Artificial Sequence
  Ly1464 MHC HLA A1 binding peptide
SAEPQAGSP

SEQ ID NO: 10618 - protein, 9 aa, Artificial Sequence
  Ly1464 MHC HLA A1 binding peptide
AREAGFQVK

SEQ ID NO: 10619 - protein, 9 aa, Artificial Sequence
  Ly1464 MHC HLA A2 binding peptide
YLSLGVLWV

SEQ ID NO: 10620 - protein, 9 aa, Artificial Sequence
  Ly1464 MHC HLA A2 binding peptide
LLLKHMQDV

SEQ ID NO: 10621 - protein, 9 aa, Artificial Sequence
  Ly1464 MHC HLA A2 binding peptide
VLMAWALYL

SEQ ID NO: 10622 - protein, 9 aa, Artificial Sequence
  Ly1464 MHC HLA A2 binding peptide
VLWVAQMLL

SEQ ID NO: 10623 - protein, 9 aa, Artificial Sequence
  Ly1464 MHC HLA A2 binding peptide
MLLAASFET

SEQ ID NO: 10624 - protein, 9 aa, Artificial Sequence
  Ly1464 MHC HLA A2 binding peptide
ILQGPAKPV

SEQ ID NO: 10625 - protein, 9 aa, Artificial Sequence
  Ly1464 MHC HLA A2 binding peptide
LLGHLLMEL

SEQ ID NO: 10626 - protein, 9 aa, Artificial Sequence
  Ly1464 MHC HLA A2 binding peptide
LLAASFETL

SEQ ID NO: 10627 - protein, 9 aa, Artificial Sequence
  Ly1464 MHC HLA A2 binding peptide
WQDWPLTQV

SEQ ID NO: 10628 - protein, 9 aa, Artificial Sequence
  Ly1464 MHC HLA A2 binding peptide
YTFSEPFHL

SEQ ID NO: 10629 - protein, 9 aa, Artificial Sequence
  Ly1464 MHC HLA A2 binding peptide
LIVSYDWLI

SEQ ID NO: 10630 - protein, 9 aa, Artificial Sequence
  Ly1464 MHC HLA A2 binding peptide
KLPLQRSAA

SEQ ID NO: 10631 - protein, 9 aa, Artificial Sequence
  Ly1464 MHC HLA A2 binding peptide
WALYLSLGV

SEQ ID NO: 10632 - protein, 9 aa, Artificial Sequence
  Ly1464 MHC HLA A2 binding peptide
CQAWQDWPL

SEQ ID NO: 10633 - protein, 9 aa, Artificial Sequence
  Ly1464 MHC HLA A2 binding peptide
GIPETASVV

SEQ ID NO: 10634 - protein, 9 aa, Artificial Sequence
  Ly1464 MHC HLA A2 binding peptide
QVWKQSPQL

SEQ ID NO: 10635 - protein, 9 aa, Artificial Sequence
  Ly1464 MHC HLA A2 binding peptide
ALYLSLGVL

SEQ ID NO: 10636 - protein, 9 aa, Artificial Sequence
  Ly1464 MHC HLA A2 binding peptide
QMGLLLKHM

SEQ ID NO: 10637 - protein, 9 aa, Artificial Sequence
  Ly1464 MHC HLA A2 binding peptide
VVAITVQEL

SEQ ID NO: 10638 - protein, 9 aa, Artificial Sequence
  Ly1464 MHC HLA A2 binding peptide
GVLWVAQML

SEQ ID NO: 10639 - protein, 9 aa, Artificial Sequence
  Ly1464 MHC HLA A3 binding peptide
WLILQGPAK

SEQ ID NO: 10640 - protein, 9 aa, Artificial Sequence
  Ly1464 MHC HLA A3 binding peptide
ELFPAPILR

SEQ ID NO: 10641 - protein, 9 aa, Artificial Sequence
  Ly1464 MHC HLA A3 binding peptide
ALGPPGPNR

SEQ ID NO: 10642 - protein, 9 aa, Artificial Sequence
  Ly1464 MHC HLA A3 binding peptide
VLWVAQMLL

SEQ ID NO: 10643 - protein, 9 aa, Artificial Sequence
  Ly1464 MHC HLA A3 binding peptide
VLMAWALYL

SEQ ID NO: 10644 - protein, 9 aa, Artificial Sequence
  Ly1464 MHC HLA A3 binding peptide
LLKHMQDVR

SEQ ID NO: 10645 - protein, 9 aa, Artificial Sequence
  Ly1464 MHC HLA A3 binding peptide
KLGCVLMAW

SEQ ID NO: 10646 - protein, 9 aa, Artificial Sequence
  Ly1464 MHC HLA A3 binding peptide
PMTLSCQTK

SEQ ID NO: 10647 - protein, 9 aa, Artificial Sequence
  Ly1464 MHC HLA A3 binding peptide
LLGHLLMEL

SEQ ID NO: 10648 - protein, 9 aa, Artificial Sequence
  Ly1464 MHC HLA A3 binding peptide
GMPDPHLYH

SEQ ID NO: 10649 - protein, 9 aa, Artificial Sequence
  Ly1464 MHC HLA A3 binding peptide
PLTQVTFYR

SEQ ID NO: 10650 - protein, 9 aa, Artificial Sequence
  Ly1464 MHC HLA A3 binding peptide
LLAASFETL

SEQ ID NO: 10651 - protein, 9 aa, Artificial Sequence
  Ly1464 MHC HLA A3 binding peptide
HLYHQMGLL

SEQ ID NO: 10652 - protein, 9 aa, Artificial Sequence
  Ly1464 MHC HLA A3 binding peptide
ALYLSLGVL

SEQ ID NO: 10653 - protein, 9 aa, Artificial Sequence
  Ly1464 MHC HLA A3 binding peptide
YLSLGVLWV

SEQ ID NO: 10654 - protein, 9 aa, Artificial Sequence
  Ly1464 MHC HLA A3 binding peptide
ATEDNQVWK

SEQ ID NO: 10655 - protein, 9 aa, Artificial Sequence
  Ly1464 MHC HLA A3 binding peptide
HMQDVRVLL

SEQ ID NO: 10656 - protein, 9 aa, Artificial Sequence
  Ly1464 MHC HLA A3 binding peptide
HLIVSYDWL

SEQ ID NO: 10657 - protein, 9 aa, Artificial Sequence
  Ly1464 MHC HLA A3 binding peptide
KAYTFSEPF

SEQ ID NO: 10658 - protein, 9 aa, Artificial Sequence
  Ly1464 MHC HLA A3 binding peptide
KQSPQLEIR

SEQ ID NO: 10659 - protein, 9 aa, Artificial Sequence
  Ly1464 MHC HLA A11 binding peptide
ATEDNQVWK

SEQ ID NO: 10660 - protein, 9 aa, Artificial Sequence
  Ly1464 MHC HLA A11 binding peptide
WLILQGPAK

SEQ ID NO: 10661 - protein, 9 aa, Artificial Sequence
  Ly1464 MHC HLA A11 binding peptide
KQSPQLEIR

SEQ ID NO: 10662 - protein, 9 aa, Artificial Sequence
  Ly1464 MHC HLA A11 binding peptide
CQTKLPLQR

SEQ ID NO: 10663 - protein, 9 aa, Artificial Sequence
  Ly1464 MHC HLA A11 binding peptide
RVLLGHLLM

SEQ ID NO: 10664 - protein, 9 aa, Artificial Sequence
  Ly1464 MHC HLA A11 binding peptide
PTLNPAPQK

SEQ ID NO: 10665 - protein, 9 aa, Artificial Sequence
  Ly1464 MHC HLA A11 binding peptide
ELFPAPILR

SEQ ID NO: 10666 - protein, 9 aa, Artificial Sequence
  Ly1464 MHC HLA A11 binding peptide
ARLLFSFYK

SEQ ID NO: 10667 - protein, 9 aa, Artificial Sequence
  Ly1464 MHC HLA A11 binding peptide
GVLWVAQML

SEQ ID NO: 10668 - protein, 9 aa, Artificial Sequence
  Ly1464 MHC HLA A11 binding peptide
LLKHMQDVR

SEQ ID NO: 10669 - protein, 9 aa, Artificial Sequence
  Ly1464 MHC HLA A11 binding peptide
ALGPPGPNR

SEQ ID NO: 10670 - protein, 9 aa, Artificial Sequence
  Ly1464 MHC HLA A11 binding peptide
GHRKPGTTK

SEQ ID NO: 10671 - protein, 9 aa, Artificial Sequence
  Ly1464 MHC HLA A11 binding peptide
RVQGASSSA

SEQ ID NO: 10672 - protein, 9 aa, Artificial Sequence
  Ly1464 MHC HLA A11 binding peptide
LPLQRSAAR

SEQ ID NO: 10673 - protein, 9 aa, Artificial Sequence
  Ly1464 MHC HLA A11 binding peptide
EFSITVVQK

SEQ ID NO: 10674 - protein, 9 aa, Artificial Sequence
  Ly1464 MHC HLA A11 binding peptide
YTFSEPFHL

SEQ ID NO: 10675 - protein, 9 aa, Artificial Sequence
  Ly1464 MHC HLA A11 binding peptide
ITVQELFPA

SEQ ID NO: 10676 - protein, 9 aa, Artificial Sequence
  Ly1464 MHC HLA A11 binding peptide
YHQMGLLLK

SEQ ID NO: 10677 - protein, 9 aa, Artificial Sequence
  Ly1464 MHC HLA A11 binding peptide
QVWKQSPQL

SEQ ID NO: 10678 - protein, 9 aa, Artificial Sequence
  Ly1464 MHC HLA A11 binding peptide
LFSFYKDGR

SEQ ID NO: 10679 - protein, 9 aa, Artificial Sequence
  Ly1464 MHC HLA A24 binding peptide
LYHQMGLLL

SEQ ID NO: 10680 - protein, 9 aa, Artificial Sequence
  Ly1464 MHC HLA A24 binding peptide
VFEGDLLVL

SEQ ID NO: 10681 - protein, 9 aa, Artificial Sequence
  Ly1464 MHC HLA A24 binding peptide
TFYRDGSAL

SEQ ID NO: 10682 - protein, 9 aa, Artificial Sequence
  Ly1464 MHC HLA A24 binding peptide
GFQVKAYTF

SEQ ID NO: 10683 - protein, 9 aa, Artificial Sequence
  Ly1464 MHC HLA A24 binding peptide
KPVFEGDLL

SEQ ID NO: 10684 - protein, 9 aa, Artificial Sequence
  Ly1464 MHC HLA A24 binding peptide
HMQDVRVLL

SEQ ID NO: 10685 - protein, 9 aa, Artificial Sequence
  Ly1464 MHC HLA A24 binding peptide
GVLWVAQML

SEQ ID NO: 10686 - protein, 9 aa, Artificial Sequence
  Ly1464 MHC HLA A24 binding peptide
LYLSLGVLW

SEQ ID NO: 10687 - protein, 9 aa, Artificial Sequence
  Ly1464 MHC HLA A24 binding peptide
IFQSPGPGI

SEQ ID NO: 10688 - protein, 9 aa, Artificial Sequence
  Ly1464 MHC HLA A24 binding peptide
APEEAPGPL

SEQ ID NO: 10689 - protein, 9 aa, Artificial Sequence
  Ly1464 MHC HLA A24 binding peptide
TFSEPFHLI

SEQ ID NO: 10690 - protein, 9 aa, Artificial Sequence
  Ly1464 MHC HLA A24 binding peptide
HLLMELREL

SEQ ID NO: 10691 - protein, 9 aa, Artificial Sequence
  Ly1464 MHC HLA A24 binding peptide
MTLSCQTKL

SEQ ID NO: 10692 - protein, 9 aa, Artificial Sequence
  Ly1464 MHC HLA A24 binding peptide
VLMAWALYL

SEQ ID NO: 10693 - protein, 9 aa, Artificial Sequence
  Ly1464 MHC HLA A24 binding peptide
HLIVSYDWL

SEQ ID NO: 10694 - protein, 9 aa, Artificial Sequence
  Ly1464 MHC HLA A24 binding peptide
GCVLMAWAL

SEQ ID NO: 10695 - protein, 9 aa, Artificial Sequence
  Ly1464 MHC HLA A24 binding peptide
LLGHLLMEL

SEQ ID NO: 10696 - protein, 9 aa, Artificial Sequence
  Ly1464 MHC HLA A24 binding peptide
VVAITVQEL

SEQ ID NO: 10697 - protein, 9 aa, Artificial Sequence
  Ly1464 MHC HLA A24 binding peptide
MAWALYLSL

SEQ ID NO: 10698 - protein, 9 aa, Artificial Sequence
  Ly1464 MHC HLA A24 binding peptide
DVRVLLGHL

SEQ ID NO: 10699 - protein, 9 aa, Artificial Sequence
  Ly1464 MHC HLA A68 binding peptide
ELFPAPILR

SEQ ID NO: 10700 - protein, 9 aa, Artificial Sequence
  Ly1464 MHC HLA A68 binding peptide
ATEDNQVWK

SEQ ID NO: 10701 - protein, 9 aa, Artificial Sequence
  Ly1464 MHC HLA A68 binding peptide
ELRELSGHR

SEQ ID NO: 10702 - protein, 9 aa, Artificial Sequence
  Ly1464 MHC HLA A68 binding peptide
DVRVLLGHL

SEQ ID NO: 10703 - protein, 9 aa, Artificial Sequence
  Ly1464 MHC HLA A68 binding peptide
ALGPPGPNR

SEQ ID NO: 10704 - protein, 9 aa, Artificial Sequence
  Ly1464 MHC HLA A68 binding peptide
LPLQRSAAR

SEQ ID NO: 10705 - protein, 9 aa, Artificial Sequence
  Ly1464 MHC HLA A68 binding peptide
ETLQCEGPV

SEQ ID NO: 10706 - protein, 9 aa, Artificial Sequence
  Ly1464 MHC HLA A68 binding peptide
RVLLGHLLM

SEQ ID NO: 10707 - protein, 9 aa, Artificial Sequence
  Ly1464 MHC HLA A68 binding peptide
VVAITVQEL

SEQ ID NO: 10708 - protein, 9 aa, Artificial Sequence
  Ly1464 MHC HLA A68 binding peptide
WVAQMLLAA

SEQ ID NO: 10709 - protein, 9 aa, Artificial Sequence
  Ly1464 MHC HLA A68 binding peptide
GVLWVAQML

SEQ ID NO: 10710 - protein, 9 aa, Artificial Sequence
  Ly1464 MHC HLA A68 binding peptide
KQSPQLEIR

SEQ ID NO: 10711 - protein, 9 aa, Artificial Sequence
  Ly1464 MHC HLA A68 binding peptide
PTLNPAPQK

SEQ ID NO: 10712 - protein, 9 aa, Artificial Sequence
  Ly1464 MHC HLA A68 binding peptide
AVPSAEPQA

SEQ ID NO: 10713 - protein, 9 aa, Artificial Sequence
  Ly1464 MHC HLA A68 binding peptide
ETASVVAIT

SEQ ID NO: 10714 - protein, 9 aa, Artificial Sequence
  Ly1464 MHC HLA A68 binding peptide
VVQKADSGH

SEQ ID NO: 10715 - protein, 9 aa, Artificial Sequence
  Ly1464 MHC HLA A68 binding peptide
WLILQGPAK

SEQ ID NO: 10716 - protein, 9 aa, Artificial Sequence
  Ly1464 MHC HLA A68 binding peptide
LLKHMQDVR

SEQ ID NO: 10717 - protein, 9 aa, Artificial Sequence
  Ly1464 MHC HLA A68 binding peptide
CQTKLPLQR

SEQ ID NO: 10718 - protein, 9 aa, Artificial Sequence
  Ly1464 MHC HLA A68 binding peptide
RVQGASSSA

SEQ ID NO: 10719 - protein, 9 aa, Artificial Sequence
  Ly1464 MHC HLA B7 binding peptide
DVRVLLGHL

SEQ ID NO: 10720 - protein, 9 aa, Artificial Sequence
  Ly1464 MHC HLA B7 binding peptide
KPVFEGDLL

SEQ ID NO: 10721 - protein, 9 aa, Artificial Sequence
  Ly1464 MHC HLA B7 binding peptide
APEEAPGPL

SEQ ID NO: 10722 - protein, 9 aa, Artificial Sequence
  Ly1464 MHC HLA B7 binding peptide
LQRSAARLL

SEQ ID NO: 10723 - protein, 9 aa, Artificial Sequence
  Ly1464 MHC HLA B7 binding peptide
QVWKQSPQL

SEQ ID NO: 10724 - protein, 9 aa, Artificial Sequence
  Ly1464 MHC HLA B7 binding peptide
VVAITVQEL

SEQ ID NO: 10725 - protein, 9 aa, Artificial Sequence
  Ly1464 MHC HLA B7 binding peptide
IVSYDWLIL

SEQ ID NO: 10726 - protein, 9 aa, Artificial Sequence
  Ly1464 MHC HLA B7 binding peptide
GVLWVAQML

SEQ ID NO: 10727 - protein, 9 aa, Artificial Sequence
  Ly1464 MHC HLA B7 binding peptide
VLMAWALYL

SEQ ID NO: 10728 - protein, 9 aa, Artificial Sequence
  Ly1464 MHC HLA B7 binding peptide
MAWALYLSL

SEQ ID NO: 10729 - protein, 9 aa, Artificial Sequence
  Ly1464 MHC HLA B7 binding peptide
ALYLSLGVL

SEQ ID NO: 10730 - protein, 9 aa, Artificial Sequence
  Ly1464 MHC HLA B7 binding peptide
HMQDVRVLL

SEQ ID NO: 10731 - protein, 9 aa, Artificial Sequence
  Ly1464 MHC HLA B7 binding peptide
APGTAPEEA

SEQ ID NO: 10732 - protein, 9 aa, Artificial Sequence
  Ly1464 MHC HLA B7 binding peptide
SPMTLSCQT

SEQ ID NO: 10733 - protein, 9 aa, Artificial Sequence
  Ly1464 MHC HLA B7 binding peptide
DAREAGFQV

SEQ ID NO: 10734 - protein, 9 aa, Artificial Sequence
  Ly1464 MHC HLA B7 binding peptide
RVLLGHLLM

SEQ ID NO: 10735 - protein, 9 aa, Artificial Sequence
  Ly1464 MHC HLA B7 binding peptide
HLLMELREL

SEQ ID NO: 10736 - protein, 9 aa, Artificial Sequence
  Ly1464 MHC HLA B7 binding peptide
LLGHLLMEL

SEQ ID NO: 10737 - protein, 9 aa, Artificial Sequence
  Ly1464 MHC HLA B7 binding peptide
VLWVAQMLL

SEQ ID NO: 10738 - protein, 9 aa, Artificial Sequence
  Ly1464 MHC HLA B7 binding peptide
HLYHQMGLL

SEQ ID NO: 10739 - protein, 9 aa, Artificial Sequence
  Ly1464 MHC HLA B8 binding peptide
DVRVLLGHL

SEQ ID NO: 10740 - protein, 9 aa, Artificial Sequence
  Ly1464 MHC HLA B8 binding peptide
DAREAGFQV

SEQ ID NO: 10741 - protein, 9 aa, Artificial Sequence
  Ly1464 MHC HLA B8 binding peptide
LQRSAARLL

SEQ ID NO: 10742 - protein, 9 aa, Artificial Sequence
  Ly1464 MHC HLA B8 binding peptide
FSFYKDGRI

SEQ ID NO: 10743 - protein, 9 aa, Artificial Sequence
  Ly1464 MHC HLA B8 binding peptide
GCVLMAWAL

SEQ ID NO: 10744 - protein, 9 aa, Artificial Sequence
  Ly1464 MHC HLA B8 binding peptide
MAWALYLSL

SEQ ID NO: 10745 - protein, 9 aa, Artificial Sequence
  Ly1464 MHC HLA B8 binding peptide
LLGHLLMEL

SEQ ID NO: 10746 - protein, 9 aa, Artificial Sequence
  Ly1464 MHC HLA B8 binding peptide
HLYHQMGLL

SEQ ID NO: 10747 - protein, 9 aa, Artificial Sequence
  Ly1464 MHC HLA B8 binding peptide
VLMAWALYL

SEQ ID NO: 10748 - protein, 9 aa, Artificial Sequence
  Ly1464 MHC HLA B8 binding peptide
AARLLFSFY

SEQ ID NO: 10749 - protein, 9 aa, Artificial Sequence
  Ly1464 MHC HLA B8 binding peptide
APILRAVPS

SEQ ID NO: 10750 - protein, 9 aa, Artificial Sequence
  Ly1464 MHC HLA B8 binding peptide
ALYLSLGVL

SEQ ID NO: 10751 - protein, 9 aa, Artificial Sequence
  Ly1464 MHC HLA B8 binding peptide
HLIVSYDWL

SEQ ID NO: 10752 - protein, 9 aa, Artificial Sequence
  Ly1464 MHC HLA B8 binding peptide
LLAASFETL

SEQ ID NO: 10753 - protein, 9 aa, Artificial Sequence
  Ly1464 MHC HLA B8 binding peptide
VLWVAQMLL

SEQ ID NO: 10754 - protein, 9 aa, Artificial Sequence
  Ly1464 MHC HLA B8 binding peptide
HMQDVRVLL

SEQ ID NO: 10755 - protein, 9 aa, Artificial Sequence
  Ly1464 MHC HLA B8 binding peptide
APEEAPGPL

SEQ ID NO: 10756 - protein, 9 aa, Artificial Sequence
  Ly1464 MHC HLA B8 binding peptide
LSGHRKPGT

SEQ ID NO: 10757 - protein, 9 aa, Artificial Sequence
  Ly1464 MHC HLA B8 binding peptide
GVLWVAQML

SEQ ID NO: 10758 - protein, 9 aa, Artificial Sequence
  Ly1464 MHC HLA B8 binding peptide
SSSAAPPTL

SEQ ID NO: 10759 - protein, 9 aa, Artificial Sequence
  Ly1464 MHC HLA B27 binding peptide
LRELSGHRK

SEQ ID NO: 10760 - protein, 9 aa, Artificial Sequence
  Ly1464 MHC HLA B27 binding peptide
VRVLLGHLL

SEQ ID NO: 10761 - protein, 9 aa, Artificial Sequence
  Ly1464 MHC HLA B27 binding peptide
ARLLFSFYK

SEQ ID NO: 10762 - protein, 9 aa, Artificial Sequence
  Ly1464 MHC HLA B27 binding peptide
AREAGFQVK

SEQ ID NO: 10763 - protein, 9 aa, Artificial Sequence
  Ly1464 MHC HLA B27 binding peptide
QRSAARLLF

SEQ ID NO: 10764 - protein, 9 aa, Artificial Sequence
  Ly1464 MHC HLA B27 binding peptide
GRIVQSRGL

SEQ ID NO: 10765 - protein, 9 aa, Artificial Sequence
  Ly1464 MHC HLA B27 binding peptide
NREFSITVV

SEQ ID NO: 10766 - protein, 9 aa, Artificial Sequence
  Ly1464 MHC HLA B27 binding peptide
KQSPQLEIR

SEQ ID NO: 10767 - protein, 9 aa, Artificial Sequence
  Ly1464 MHC HLA B27 binding peptide
HRKPGTTKA

SEQ ID NO: 10768 - protein, 9 aa, Artificial Sequence
  Ly1464 MHC HLA B27 binding peptide
IRVQGASSS

SEQ ID NO: 10769 - protein, 9 aa, Artificial Sequence
  Ly1464 MHC HLA B27 binding peptide
CQAWQDWPL

SEQ ID NO: 10770 - protein, 9 aa, Artificial Sequence
  Ly1464 MHC HLA B27 binding peptide
LRCQAWQDW

SEQ ID NO: 10771 - protein, 9 aa, Artificial Sequence
  Ly1464 MHC HLA B27 binding peptide
HLYHQMGLL

SEQ ID NO: 10772 - protein, 9 aa, Artificial Sequence
  Ly1464 MHC HLA B27 binding peptide
ALYLSLGVL

SEQ ID NO: 10773 - protein, 9 aa, Artificial Sequence
  Ly1464 MHC HLA B27 binding peptide
VLWVAQMLL

SEQ ID NO: 10774 - protein, 9 aa, Artificial Sequence
  Ly1464 MHC HLA B27 binding peptide
CQTKLPLQR

SEQ ID NO: 10775 - protein, 9 aa, Artificial Sequence
  Ly1464 MHC HLA B27 binding peptide
VQKADSGHY

SEQ ID NO: 10776 - protein, 9 aa, Artificial Sequence
  Ly1464 MHC HLA B27 binding peptide
LQGPAKPVF

SEQ ID NO: 10777 - protein, 9 aa, Artificial Sequence
  Ly1464 MHC HLA B27 binding peptide
AQMLLAASF

SEQ ID NO: 10778 - protein, 9 aa, Artificial Sequence
  Ly1464 MHC HLA B27 binding peptide
KAYTFSEPF

SEQ ID NO: 10779 - protein, 9 aa, Artificial Sequence
  Ly1464 MHC HLA B35 binding peptide
KPVFEGDLL

SEQ ID NO: 10780 - protein, 9 aa, Artificial Sequence
  Ly1464 MHC HLA B35 binding peptide
WPLTQVTFY

SEQ ID NO: 10781 - protein, 9 aa, Artificial Sequence
  Ly1464 MHC HLA B35 binding peptide
EPFHLIVSY

SEQ ID NO: 10782 - protein, 9 aa, Artificial Sequence
  Ly1464 MHC HLA B35 binding peptide
TPSSEDPGF

SEQ ID NO: 10783 - protein, 9 aa, Artificial Sequence
  Ly1464 MHC HLA B35 binding peptide
GPPGPNREF

SEQ ID NO: 10784 - protein, 9 aa, Artificial Sequence
  Ly1464 MHC HLA B35 binding peptide
AARLLFSFY

SEQ ID NO: 10785 - protein, 9 aa, Artificial Sequence
  Ly1464 MHC HLA B35 binding peptide
QSRGLSSEF

SEQ ID NO: 10786 - protein, 9 aa, Artificial Sequence
  Ly1464 MHC HLA B35 binding peptide
APEEAPGPL

SEQ ID NO: 10787 - protein, 9 aa, Artificial Sequence
  Ly1464 MHC HLA B35 binding peptide
VQKADSGHY

SEQ ID NO: 10788 - protein, 9 aa, Artificial Sequence
  Ly1464 MHC HLA B35 binding peptide
ASEDHSGSY

SEQ ID NO: 10789 - protein, 9 aa, Artificial Sequence
  Ly1464 MHC HLA B35 binding peptide
KAYTFSEPF

SEQ ID NO: 10790 - protein, 9 aa, Artificial Sequence
  Ly1464 MHC HLA B35 binding peptide
EAGFQVKAY

SEQ ID NO: 10791 - protein, 9 aa, Artificial Sequence
  Ly1464 MHC HLA B35 binding peptide
SSSAAPPTL

SEQ ID NO: 10792 - protein, 9 aa, Artificial Sequence
  Ly1464 MHC HLA B35 binding peptide
LSCQTKLPL

SEQ ID NO: 10793 - protein, 9 aa, Artificial Sequence
  Ly1464 MHC HLA B35 binding peptide
SSCHTEDDL

SEQ ID NO: 10794 - protein, 9 aa, Artificial Sequence
  Ly1464 MHC HLA B35 binding peptide
AATEDNQVW

SEQ ID NO: 10795 - protein, 9 aa, Artificial Sequence
  Ly1464 MHC HLA B35 binding peptide
KPGTTKATA

SEQ ID NO: 10796 - protein, 9 aa, Artificial Sequence
  Ly1464 MHC HLA B35 binding peptide
RVLLGHLLM

SEQ ID NO: 10797 - protein, 9 aa, Artificial Sequence
  Ly1464 MHC HLA B35 binding peptide
FPAPILRAV

SEQ ID NO: 10798 - protein, 9 aa, Artificial Sequence
  Ly1464 MHC HLA B35 binding peptide
DAREAGFQV

SEQ ID NO: 10799 - protein, 9 aa, Artificial Sequence
  Ly1464 MHC HLA B44 binding peptide
LEIRVQGAS

SEQ ID NO: 10800 - protein, 9 aa, Artificial Sequence
  Ly1464 MHC HLA B44 binding peptide
WPLTQVTFY

SEQ ID NO: 10801 - protein, 9 aa, Artificial Sequence
  Ly1464 MHC HLA B44 binding peptide
SEDHSGSYW

SEQ ID NO: 10802 - protein, 9 aa, Artificial Sequence
  Ly1464 MHC HLA B44 binding peptide
REAGFQVKA

SEQ ID NO: 10803 - protein, 9 aa, Artificial Sequence
  Ly1464 MHC HLA B44 binding peptide
EAGFQVKAY

SEQ ID NO: 10804 - protein, 9 aa, Artificial Sequence
  Ly1464 MHC HLA B44 binding peptide
LGMPDPHLY

SEQ ID NO: 10805 - protein, 9 aa, Artificial Sequence
  Ly1464 MHC HLA B44 binding peptide
SEFQIPTAS

SEQ ID NO: 10806 - protein, 9 aa, Artificial Sequence
  Ly1464 MHC HLA B44 binding peptide
AEPQAGSPM

SEQ ID NO: 10807 - protein, 9 aa, Artificial Sequence
  Ly1464 MHC HLA B44 binding peptide
QELFPAPIL

SEQ ID NO: 10808 - protein, 9 aa, Artificial Sequence
  Ly1464 MHC HLA B44 binding peptide
SEPFHLIVS

SEQ ID NO: 10809 - protein, 9 aa, Artificial Sequence
  Ly1464 MHC HLA B44 binding peptide
SAARLLFSF

SEQ ID NO: 10810 - protein, 9 aa, Artificial Sequence
  Ly1464 MHC HLA B44 binding peptide
VAITVQELF

SEQ ID NO: 10811 - protein, 9 aa, Artificial Sequence
  Ly1464 MHC HLA B44 binding peptide
ASEDHSGSY

SEQ ID NO: 10812 - protein, 9 aa, Artificial Sequence
  Ly1464 MHC HLA B44 binding peptide
AARLLFSFY

SEQ ID NO: 10813 - protein, 9 aa, Artificial Sequence
  Ly1464 MHC HLA B44 binding peptide
DDLTDAREA

SEQ ID NO: 10814 - protein, 9 aa, Artificial Sequence
  Ly1464 MHC HLA B44 binding peptide
FSITVVQKA

SEQ ID NO: 10815 - protein, 9 aa, Artificial Sequence
  Ly1464 MHC HLA B44 binding peptide
EPFHLIVSY

SEQ ID NO: 10816 - protein, 9 aa, Artificial Sequence
  Ly1464 MHC HLA B44 binding peptide
AQMLLAASF

SEQ ID NO: 10817 - protein, 9 aa, Artificial Sequence
  Ly1464 MHC HLA B44 binding peptide
TEDNQVWKQ

SEQ ID NO: 10818 - protein, 9 aa, Artificial Sequence
  Ly1464 MHC HLA B44 binding peptide
CEGPVCTEE

SEQ ID NO: 10819 - skipped

SEQ ID NO: 10820 - protein, 30 aa, Artificial Sequence
  Ly1464 immunogenic peptide
MKLGCVLMAWALYLSLGVLWVAQMLLAASF

SEQ ID NO: 10821 - protein, 30 aa, Artificial Sequence
  Ly1464 immunogenic peptide
LGVLWVAQMLLAASFETLQCEGPVCTEESS

SEQ ID NO: 10822 - protein, 30 aa, Artificial Sequence
  Ly1464 immunogenic peptide
ETLQCEGPVCTEESSCHTEDDLTDAREAGF

SEQ ID NO: 10823 - protein, 30 aa, Artificial Sequence
  Ly1464 immunogenic peptide
CHTEDDLTDAREAGFQVKAYTFSEPFHLIV

SEQ ID NO: 10824 - protein, 30 aa, Artificial Sequence
  Ly1464 immunogenic peptide
QVKAYTFSEPFHLIVSYDWLILQGPAKPVF

SEQ ID NO: 10825 - protein, 30 aa, Artificial Sequence
  Ly1464 immunogenic peptide
SYDWLILQGPAKPVFEGDLLVLRCQAWQDW

SEQ ID NO: 10826 - protein, 30 aa, Artificial Sequence
  Ly1464 immunogenic peptide
EGDLLVLRCQAWQDWPLTQVTFYRDGSALG

SEQ ID NO: 10827 - protein, 30 aa, Artificial Sequence
  Ly1464 immunogenic peptide
PLTQVTFYRDGSALGPPGPNREFSITVVQK

SEQ ID NO: 10828 - protein, 30 aa, Artificial Sequence
  Ly1464 immunogenic peptide
PPGPNREFSITVVQKADSGHYHCSGIFQSP

SEQ ID NO: 10829 - protein, 30 aa, Artificial Sequence
  Ly1464 immunogenic peptide
ADSGHYHCSGIFQSPGPGIPETASVVAITV

SEQ ID NO: 10830 - protein, 30 aa, Artificial Sequence
  Ly1464 immunogenic peptide
GPGIPETASVVAITVQELFPAPILRAVPSA

SEQ ID NO: 10831 - protein, 30 aa, Artificial Sequence
  Ly1464 immunogenic peptide
QELFPAPILRAVPSAEPQAGSPMTLSCQTK

SEQ ID NO: 10832 - protein, 30 aa, Artificial Sequence
  Ly1464 immunogenic peptide
EPQAGSPMTLSCQTKLPLQRSAARLLFSFY

SEQ ID NO: 10833 - protein, 30 aa, Artificial Sequence
  Ly1464 immunogenic peptide
LPLQRSAARLLFSFYKDGRIVQSRGLSSEF

SEQ ID NO: 10834 - protein, 30 aa, Artificial Sequence
  Ly1464 immunogenic peptide
KDGRIVQSRGLSSEFQIPTASEDHSGSYWC

SEQ ID NO: 10835 - protein, 30 aa, Artificial Sequence
  Ly1464 immunogenic peptide
QIPTASEDHSGSYWCEAATEDNQVWKQSPQ

SEQ ID NO: 10836 - protein, 30 aa, Artificial Sequence
  Ly1464 immunogenic peptide
EAATEDNQVWKQSPQLEIRVQGASSSAAPP

SEQ ID NO: 10837 - protein, 30 aa, Artificial Sequence
  Ly1464 immunogenic peptide
LEIRVQGASSSAAPPTLNPAPQKSAAPGTA

SEQ ID NO: 10838 - protein, 30 aa, Artificial Sequence
  Ly1464 immunogenic peptide
TLNPAPQKSAAPGTAPEEAPGPLPPPPTPS

SEQ ID NO: 10839 - protein, 30 aa, Artificial Sequence
  Ly1464 immunogenic peptide
PEEAPGPLPPPPTPSSEDPGFSSPLGMPDP

SEQ ID NO: 10840 - protein, 30 aa, Artificial Sequence
  Ly1464 immunogenic peptide
SEDPGFSSPLGMPDPHLYHQMGLLLKHMQD

SEQ ID NO: 10841 - protein, 30 aa, Artificial Sequence
  Ly1464 immunogenic peptide
HLYHQMGLLLKHMQDVRVLLGHLLMELREL

SEQ ID NO: 10842 - protein, 29 aa, Artificial Sequence
  Ly1464 immunogenic peptide
VRVLLGHLLMELRELSGHRKPGTTKATAE

SEQ ID NO: 10843 - DNA, 32 bp, Artificial Sequence
  Ly1464-sense cloning primer
cgtccatggacatgaagctgggctgtgtcctc

SEQ ID NO: 10844 - DNA, 35 bp, Artificial Sequence
  Ly1464-antisense cloning primer
ccttctcgagctattcagcagtagcctttgtggtc

SEQ ID NO: 10845 - DNA, 1080 bp, Homo sapiens
atgaagctgggctgtgtcctcatggcctgggccctctacctttcccttggtgtgctctgggtggcccagatgctactggctgccagttttgagacgctgcagtgtgagggacctgtctgcactgaggagagcagctgccacacggaggatgacttgactgatgcaagggaagctggcttccaggtcaaggcctacactttcagtgaacccttccacctgattgtgtcctatgactggctgatcctccaaggtccagccaagccagtttttgaaggggacctgctggttctgcgctgccaggcctggcaagactggccactgactcaggtgaccttctaccgagatggctcagctctgggtccccccgggcctaacagggaattctccatcaccgtggtacaaaaggcagacagcgggcactaccactgcagtggcatcttccagagccctggtcctgggatcccagaaacagcatctgttgtggctatcacagtccaagaactgtttccagcgccaattctcagagctgtaccctcagctgaaccccaagcaggaagccccatgaccctgagttgtcagacaaagttgcccctgcagaggtcagctgcccgcctcctcttctccttctacaaggatggaaggatagtgcaaagcagggggctctcctcagaattccagatccccacagcttcagaagatcactccgggtcatactggtgtgaggcagccactgaggacaaccaagtttggaaacagagcccccagctagagatcagagtgcagggtgcttccagctctgctgcacctcccacattgaatccagctcctcagaaatcagctgctccaggaactgctcctgaggaggcccctgggcctctgcctccgccgccaaccccatcttctgaggatccaggcttttcttctcctctggggatgccagatcctcatctgtatcaccagatgggccttcttctcaaacacatgcaggatgtgagagtcctcctcggtcacctgctcatggagttgagggaattatctggccaccggaagcctgggaccacaaaggctactgctgaatag

SEQ ID NO: 10846 - DNA, 4191 bp, Homo sapiens
agcgagacttccagtccgaggtcctgctttctgctatggaactattccacatgacaagtggaggtgatgcagcgatgttcagagacggcaaagagcctcagccaagtgcagaagctgctgctgccccttctcttgccaacatctcctgcttcacccagaagctggtggagaagctgtacagtgggatgttctcggcagaccccaggcatatcctcctcttcatcctggagcacatcatggtggtcattgagactgcctcttctcaaagggacactgtcctcagcactttatacagcagtttaaataaagtcattctttattgcctatccaagccccagcagtccctctccgaatgcctcggccttctcagcatcctgggctttctgcaggagcactgggatgttgtctttgccacctacaattccaacatcagcttcctcctgtgtctcatgcattgccttttgctactcaatgagagaagttacccagaaggatttggattggagcccaagcctagaatgtctacttatcatcaagtcttcctttccccaaatgaagacgtgaaagaaaaaagagaagacttaccaagtttgagtgatgtccaacacaacatccagaagacagtgcagactctctggcagcagctggtggcacaaaggcagcagaccctggaggatgccttcaagatcgatctctctgtgaaacctggagagagggaagtgaagattgaagaggtcacaccgctctgggaggagacgatgctcaaggcctggcagcattacttagcatctgagaagaagtcactggcaagtcgttcaaatgttgcacaccacagcaaagtcactttgtggagtggaagcctgtcctcagccatgaagctgatgcccgggcggcaggccaaggaccctgagtgcaagacagaggattttgtgtcatgtatagagaactacagaagaagaggacaagagctatatgcatctttatacaaagaccatgtgcaaaggcgaaaatgtggcaacatcaaggcagccaacgcctgggccaggatccaggagcagctttttggggagctgggcttgtggagccagggggaagaaaccaagccctgttccccatgggaactcgactggagagaaggaccagctcgaatgaggaaacgcatcaaacgcttgtctcctttggaggccctgagctcaggaaggcacaaggaaagccaagacaaaaatgatcatatttctcaaacaaatgctgaaaaccaagatgaactgacactgagggaggctgagggcgagccggacgaggtgggggtggactgcacccagctgaccttcttcccagccttacacgaaagtctgcactcagaagacttcttggaactgtgtcgggaaagacaagttattttacaagagcttcttgataaagaaaaggtgacgcagaagttctccctggtgattgtgcagggccacctggtgtcagaaggggtcctgctttttggccaccaacacttctacatctgcgagaacttcacactgtctcccacgggtgatgtctactgtacccgtcactgcttatccaacatcagcgatccgttcattttcaacctgtgcagcaaagacaggtccactgaccattactcgtgccagtgccacagctacgctgacatgcgggagctacggcaggctcgcttcctcctgcaggacatcgccctggagatcttcttccacaatggatattccaagtttcttgtcttctacaacaatgatcggagtaaggcctttaaaagcttctgctctttccaacccagcctgaaggggaaagccacctcggaggacaccctcaatctaaggagataccccggctctgacaggatcatgctgcagaagtggcagaaaagggacatcagcaattttgagtatctcatgtacctcaacaccgcggctgggagaacctgcaatgactacatgcagtacccagtgttcccctgggtcctcgcagactacacctcagagacattgaacttggcaaatccgaagattttccgggatctttcaaagcccatgggggctcagaccaaggaaaggaagctgaaatttatccagaggtttaaagaagttgagaaaactgaaggagacatgactgtccagtgccactactacacccactactcctcggccatcatcgtggcctcctacctggtccggatgccacccttcacccaggccttctgcgctctgcagggcggaagcttcgacgtggcagacagaatgttccacagtgtgaagagcacgtgggagtcggcctccagagagaacatgagtgacgtcagggagctgaccccagagttcttctacctgcctgagttcttaaccaactgcaacggggtagagttcggctgcatgcaggacgggactgtgctaggagacgtgcagctccctccctgggctgatggggaccctcggaaattcatcagcctgcacagaaaggccctggaaagtgactttgtcagtgccaacctccaccattggatagaccttatttttgggtacaagcagcaggggccagccgcagtggatgctgttaatatcttccacccctacttctacggtgacagaatggacctcagcagcatcactgaccccctcatcaaaagcaccatcctggggtttgtcagcaactttggacaggtgcccaaacagctctttaccaaacctcacccagccaggactgcagcagggaagcctctgcctggaaaggatgtctccacccccgtgagcctgcctggccacccacagccctttttctacagcctgcagtcgctgaggccctcccaggtcacggtcaaagatatgtacctcttttctctaggctcagagtcccccaaaggggccattggccacattgtctctactgagaagaccattctggctgtagagaggaacaaagtgctgctgcctcctctctggaacaggaccttcagctggggctttgatgacttcagctgctgcttggggagctacggctccgacaaggtcctgatgacattcgagaacctggctgcctggggccgctgtctgtgcgccgtgtgcccatccccaacaacgattgtcacctctgggaccagcactgtggtgtgtgtgtgggagctcagcatgaccaaaggccgcccgaggggcttgcgcctccggcaggccttgtatggacacacacaggctgtcacgtgcctggcagcgtcagtcaccttcagcctcctggtgagcggctcccaggactgcacctgtatcctgtgggatctggaccacctcacccacgtgacccgcctgcccgcccatcgggaaggcatctcagccatcaccatcagtgacgtctcaggcaccattgtctcctgtgcgggagcacacttgtccctgtggaatgtcaatggacagcccctggccagcatcaccacagcctggggcccagaaggagccataacctgttgctgcctgatggagggcccagcatgggacacaagccagatcatcatcaccgggagtcaagacggcatggtccgggtttggaagactgaggatgtgaagatgtctgttcctggacggccagcaggagaggagcccctggctcagcctccaagcccaagaggccacaagtgggagaagaacctggccttgagtcgagagctggacgttagcattgctttgacagggaagcccagcaaaaccagccccgcagtgactgctctggccgtgtccagaaaccacaccaaactcctggttggtgatgagagggggagaatattctgctggtctgcagatgggtaggaagagagaggcagcagaggctctggcacaacagtgccaggctgagggtggcagaggtgactggggcctgagctctgcctacagaagaaacccccagggcctccttccccacagttctcaaggaagggcctctggcaatcacagctctgcagcccaaccctctccatggccgatgggacttctatgaaaaggatgagcacacacactcggagggctgagcagcacgctggaaactgtgacttggtgatgcccagctgcacacgaaattacacatgactcaccttattaagggctattgcactgaaaaaaaaaaaaagatgggtcgcttactggaaattattgtattgtctttattttattaaagcaactatgtttt

SEQ ID NO: 10847 - protein, 1270 aa, Homo sapiens
RDFQSEVLLSAMELFHMTSGGDAAMFRDGKEPQPSAEAAAAPSLANISCFTQKLVEKLYSGMFSADPRHILLFILEHIMVVIETASSQRDTVLSTLYSSLNKVILYCLSKPQQSLSECLGLLSILGFLQEHWDVVFATYNSNISFLLCLMHCLLLLNERSYPEGFGLEPKPRMSTYHQVFLSPNEDVKEKREDLPSLSDVQHNIQKTVQTLWQQLVAQRQQTLEDAFKIDLSVKPGEREVKIEEVTPLWEETMLKAWQHYLASEKKSLASRSNVAHHSKVTLWSGSLSSAMKLMPGRQAKDPECKTEDFVSCIENYRRRGQELYASLYKDHVQRRKCGNIKAANAWARIQEQLFGELGLWSQGEETKPCSPWELDWREGPARMRKRIKRLSPLEALSSGRHKESQDKNDHISQTNAENQDELTLREAEGEPDEVGVDCTQLTFFPALHESLHSEDFLELCRERQVILQELLDKEKVTQKFSLVIVQGHLVSEGVLLFGHQHFYICENFTLSPTGDVYCTRHCLSNISDPFIFNLCSKDRSTDHYSCQCHSYADMRELRQARFLLQDIALEIFFHNGYSKFLVFYNNDRSKAFKSFCSFQPSLKGKATSEDTLNLRRYPGSDRIMLQKWQKRDISNFEYLMYLNTAAGRTCNDYMQYPVFPWVLADYTSETLNLANPKIFRDLSKPMGAQTKERKLKFIQRFKEVEKTEGDMTVQCHYYTHYSSAIIVASYLVRMPPFTQAFCALQGGSFDVADRMFHSVKSTWESASRENMSDVRELTPEFFYLPEFLTNCNGVEFGCMQDGTVLGDVQLPPWADGDPRKFISLHRKALESDFVSANLHHWIDLIFGYKQQGPAAVDAVNIFHPYFYGDRMDLSSITDPLIKSTILGFVSNFGQVPKQLFTKPHPARTAAGKPLPGKDVSTPVSLPGHPQPFFYSLQSLRPSQVTVKDMYLFSLGSESPKGAIGHIVSTEKTILAVERNKVLLPPLWNRTFSWGFDDFSCCLGSYGSDKVLMTFENLAAWGRCLCAVCPSPTTIVTSGTSTVVCVWELSMTKGRPRGLRLRQALYGHTQAVTCLAASVTFSLLVSGSQDCTCILWDLDHLTHVTRLPAHREGISAITISDVSGTIVSCAGAHLSLWNVNGQPLASITTAWGPEGAITCCCLMEGPAWDTSQIIITGSQDGMVRVWKTEDVKMSVPGRPAGEEPLAQPPSPRGHKWEKNLALSRELDVSIALTGKPSKTSPAVTALAVSRNHTKLLVGDERGRIFCWSADG

SEQ ID NO: 10848 - protein, 647 aa, Homo sapiens
MLQKWQKRDISNFEYLMYLNTAAGRTCNDYMQYPVFPWVLADYTSETLNLANPKIFRDLSKPMGAQTKERKLKFIQRFKEVEKTEGDMTVQCHYYTHYSSAIIVASYLVRMPPFTQAFCALQGGSFDVADRMFHSVKSTWESASRENMSDVRELTPEFFYLPEFLTNCNGVEFGCMQDGTVLGDVQLPPWADGDPRKFISLHRKALESDFVSANLHHWIDLIFGYKQQGPAAVDAVNIFHPYFYGDRMDLSSITDPLIKSTILGFVSNFGQVPKQLFTKPHPARTAAGKPLPGKDVSTPVSLPGHPQPFFYSLQSLRPSQVTVKDMYLFSLGSESPKGAIGHIVSTEKTILAVERNKVLLPPLWNRTFSWGFDDFSCCLGSYGSDKVLMTFENLAAWGRCLCAVCPSPTTIVTSGTSTVVCVWELSMTKGRPRGLRLRQALYGHTQAVTCLAASVTFSLLVSGSQDCTCILWDLDHLTHVTRLPAHREGISAITISDVSGTIVSCAGAHLSLWNVNGQPLASITTAWGPEGAITCCCLMEGPAWDTSQIIITGSQDGMVRVWKTEDVKMSVPGRPAGEEPLAQPPSPRGHKWEKNLALSRELDVSIALTGKPSKTSPAVTALAVSRNHTKLLVGDERGRIFCWSADG

SEQ ID NO: 10849 - protein, 9 aa, Artificial Sequence
  Ly1484 long MHC HLA A2 class I binding peptide
FLLCLMHCL

SEQ ID NO: 10850 - protein, 9 aa, Artificial Sequence
  Ly1484 long MHC HLA A2 class I binding peptide
YLPEFLTNC

SEQ ID NO: 10851 - protein, 9 aa, Artificial Sequence
  Ly1484 long MHC HLA A2 class I binding peptide
KLYSGMFSA

SEQ ID NO: 10852 - protein, 9 aa, Artificial Sequence
  Ly1484 long MHC HLA A2 class I binding peptide
FILEHIMVV

SEQ ID NO: 10853 - protein, 9 aa, Artificial Sequence
  Ly1484 long MHC HLA A2 class I binding peptide
TLYSSLNKV

SEQ ID NO: 10854 - protein, 9 aa, Artificial Sequence
  Ly1484 long MHC HLA A2 class I binding peptide
FLQEHWDVV

SEQ ID NO: 10855 - protein, 9 aa, Artificial Sequence
  Ly1484 long MHC HLA A2 class I binding peptide
ILWDLDHLT

SEQ ID NO: 10856 - protein, 9 aa, Artificial Sequence
  Ly1484 long MHC HLA A2 class I binding peptide
ALQGGSFDV

SEQ ID NO: 10857 - protein, 9 aa, Artificial Sequence
  Ly1484 long MHC HLA A2 class I binding peptide
MQYPVFPWV

SEQ ID NO: 10858 - protein, 9 aa, Artificial Sequence
  Ly1484 long MHC HLA A2 class I binding peptide
ALYGHTQAV

SEQ ID NO: 10859 - protein, 9 aa, Artificial Sequence
  Ly1484 long MHC HLA A2 class I binding peptide
YLVRMPPFT

SEQ ID NO: 10860 - protein, 9 aa, Artificial Sequence
  Ly1484 long MHC HLA A2 class I binding peptide
CLMHCLLLL

SEQ ID NO: 10861 - protein, 9 aa, Artificial Sequence
  Ly1484 long MHC HLA A2 class I binding peptide
GLLSILGFL

SEQ ID NO: 10862 - protein, 9 aa, Artificial Sequence
  Ly1484 long MHC HLA A2 class I binding peptide
VLMTFENLA

SEQ ID NO: 10863 - protein, 9 aa, Artificial Sequence
  Ly1484 long MHC HLA A2 class I binding peptide
ILAVERNKV

SEQ ID NO: 10864 - protein, 9 aa, Artificial Sequence
  Ly1484 long MHC HLA A2 class I binding peptide
YLASEKKSL

SEQ ID NO: 10865 - protein, 9 aa, Artificial Sequence
  Ly1484 long MHC HLA A2 class I binding peptide
ELTPEFFYL

SEQ ID NO: 10866 - protein, 9 aa, Artificial Sequence
  Ly1484 long MHC HLA A2 class I binding peptide
YLMYLNTAA

SEQ ID NO: 10867 - protein, 9 aa, Artificial Sequence
  Ly1484 long MHC HLA A2 class I binding peptide
ILLFILEHI

SEQ ID NO: 10868 - protein, 9 aa, Artificial Sequence
  Ly1484 long MHC HLA A2 class I binding peptide
LLQDIALEI

SEQ ID NO: 10869 - protein, 9 aa, Artificial Sequence
  Ly1484 long MHC HLA A3 class I binding peptide
KLMPGRQAK

SEQ ID NO: 10870 - protein, 9 aa, Artificial Sequence
  Ly1484 long MHC HLA A3 class I binding peptide
VLLPPLWNR

SEQ ID NO: 10871 - protein, 9 aa, Artificial Sequence
  Ly1484 long MHC HLA A3 class I binding peptide
CLGSYGSDK

SEQ ID NO: 10872 - protein, 9 aa, Artificial Sequence
  Ly1484 long MHC HLA A3 class I binding peptide
KVILYCLSK

SEQ ID NO: 10873 - protein, 9 aa, Artificial Sequence
  Ly1484 long MHC HLA A3 class I binding peptide
CVWELSMTK

SEQ ID NO: 10874 - protein, 9 aa, Artificial Sequence
  Ly1484 long MHC HLA A3 class I binding peptide
LLFGHQHFY

SEQ ID NO: 10875 - protein, 9 aa, Artificial Sequence
  Ly1484 long MHC HLA A3 class I binding peptide
PLWEETMLK

SEQ ID NO: 10876 - protein, 9 aa, Artificial Sequence
  Ly1484 long MHC HLA A3 class I binding peptide
FLSPNEDVK

SEQ ID NO: 10877 - protein, 9 aa, Artificial Sequence
  Ly1484 long MHC HLA A3 class I binding peptide
SLYKDHVQR

SEQ ID NO: 10878 - protein, 9 aa, Artificial Sequence
  Ly1484 long MHC HLA A3 class I binding peptide
FLVFYNNDR

SEQ ID NO: 10879 - protein, 9 aa, Artificial Sequence
  Ly1484 long MHC HLA A3 class I binding peptide
KLYSGMFSA

SEQ ID NO: 10880 - protein, 9 aa, Artificial Sequence
  Ly1484 long MHC HLA A3 class I binding peptide
GLRLRQALY

SEQ ID NO: 10881 - protein, 9 aa, Artificial Sequence
  Ly1484 long MHC HLA A3 class I binding peptide
NLANPKIFR

SEQ ID NO: 10882 - protein, 9 aa, Artificial Sequence
  Ly1484 long MHC HLA A3 class I binding peptide
RVWKTEDVK

SEQ ID NO: 10883 - protein, 9 aa, Artificial Sequence
  Ly1484 long MHC HLA A3 class I binding peptide
QVPKQLFTK

SEQ ID NO: 10884 - protein, 9 aa, Artificial Sequence
  Ly1484 long MHC HLA A3 class I binding peptide
RMPPFTQAF

SEQ ID NO: 10885 - protein, 9 aa, Artificial Sequence
  Ly1484 long MHC HLA A3 class I binding peptide
KLKFIQRFK

SEQ ID NO: 10886 - protein, 9 aa, Artificial Sequence
  Ly1484 long MHC HLA A3 class I binding peptide
RIMLQKWQK

SEQ ID NO: 10887 - protein, 9 aa, Artificial Sequence
  Ly1484 long MHC HLA A3 class I binding peptide
VILQELLDK

SEQ ID NO: 10888 - protein, 9 aa, Artificial Sequence
  Ly1484 long MHC HLA A3 class I binding peptide
IMLQKWQKR

SEQ ID NO: 10889 - protein, 9 aa, Artificial Sequence
  Ly1484 long MHC HLA A24 class I binding peptide
QYPVFPWVL

SEQ ID NO: 10890 - protein, 9 aa, Artificial Sequence
  Ly1484 long MHC HLA A24 class I binding peptide
FYICENFTL

SEQ ID NO: 10891 - protein, 9 aa, Artificial Sequence
  Ly1484 long MHC HLA A24 class I binding peptide
TYNSNISFL

SEQ ID NO: 10892 - protein, 9 aa, Artificial Sequence
  Ly1484 long MHC HLA A24 class I binding peptide
NYRRRGQEL

SEQ ID NO: 10893 - protein, 9 aa, Artificial Sequence
  Ly1484 long MHC HLA A24 class I binding peptide
DYTSETLNL

SEQ ID NO: 10894 - protein, 9 aa, Artificial Sequence
  Ly1484 long MHC HLA A24 class I binding peptide
SYLVRMPPF

SEQ ID NO: 10895 - protein, 9 aa, Artificial Sequence
  Ly1484 long MHC HLA A24 class I binding peptide
RYPGSDRIM

SEQ ID NO: 10896 - protein, 9 aa, Artificial Sequence
  Ly1484 long MHC HLA A24 class I binding peptide
RFLLQDIAL

SEQ ID NO: 10897 - protein, 9 aa, Artificial Sequence
  Ly1484 long MHC HLA A24 class I binding peptide
LYSSLNKVI

SEQ ID NO: 10898 - protein, 9 aa, Artificial Sequence
  Ly1484 long MHC HLA A24 class I binding peptide
YYTHYSSAI

SEQ ID NO: 10899 - protein, 9 aa, Artificial Sequence
  Ly1484 long MHC HLA A24 class I binding peptide
FFPALHESL

SEQ ID NO: 10900 - protein, 9 aa, Artificial Sequence
  Ly1484 long MHC HLA A24 class I binding peptide
NFGQVPKQL

SEQ ID NO: 10901 - protein, 9 aa, Artificial Sequence
  Ly1484 long MHC HLA A24 class I binding peptide
SYGSDKVLM

SEQ ID NO: 10902 - protein, 9 aa, Artificial Sequence
  Ly1484 long MHC HLA A24 class I binding peptide
GFDDFSCCL

SEQ ID NO: 10903 - protein, 9 aa, Artificial Sequence
  Ly1484 long MHC HLA A24 class I binding peptide
EFFYLPEFL

SEQ ID NO: 10904 - protein, 9 aa, Artificial Sequence
  Ly1484 long MHC HLA A24 class I binding peptide
YFYGDRMDL

SEQ ID NO: 10905 - protein, 9 aa, Artificial Sequence
  Ly1484 long MHC HLA A24 class I binding peptide
SFCSFQPSL

SEQ ID NO: 10906 - protein, 9 aa, Artificial Sequence
  Ly1484 long MHC HLA A24 class I binding peptide
RGLRLRQAL

SEQ ID NO: 10907 - protein, 9 aa, Artificial Sequence
  Ly1484 long MHC HLA A24 class I binding peptide
RGQELYASL

SEQ ID NO: 10908 - protein, 9 aa, Artificial Sequence
  Ly1484 long MHC HLA A24 class I binding peptide
KNLALSREL

SEQ ID NO: 10909 - protein, 9 aa, Artificial Sequence
  Ly1484 short MHC HLA A2 class I binding peptide
YLPEFLTNC

SEQ ID NO: 10910 - protein, 9 aa, Artificial Sequence
  Ly1484 short MHC HLA A2 class I binding peptide
ILWDLDHLT

SEQ ID NO: 10911 - protein, 9 aa, Artificial Sequence
  Ly1484 short MHC HLA A2 class I binding peptide
ALQGGSFDV

SEQ ID NO: 10912 - protein, 9 aa, Artificial Sequence
  Ly1484 short MHC HLA A2 class I binding peptide
MQYPVFPWV

SEQ ID NO: 10913 - protein, 9 aa, Artificial Sequence
  Ly1484 short MHC HLA A2 class I binding peptide
ALYGHTQAV

SEQ ID NO: 10914 - protein, 9 aa, Artificial Sequence
  Ly1484 short MHC HLA A2 class I binding peptide
YLVRMPPFT

SEQ ID NO: 10915 - protein, 9 aa, Artificial Sequence
  Ly1484 short MHC HLA A2 class I binding peptide
VLMTFENLA

SEQ ID NO: 10916 - protein, 9 aa, Artificial Sequence
  Ly1484 short MHC HLA A2 class I binding peptide
ILAVERNKV

SEQ ID NO: 10917 - protein, 9 aa, Artificial Sequence
  Ly1484 short MHC HLA A2 class I binding peptide
ELTPEFFYL

SEQ ID NO: 10918 - protein, 9 aa, Artificial Sequence
  Ly1484 short MHC HLA A2 class I binding peptide
YLMYLNTAA

SEQ ID NO: 10919 - protein, 9 aa, Artificial Sequence
  Ly1484 short MHC HLA A2 class I binding peptide
VLADYTSET

SEQ ID NO: 10920 - protein, 9 aa, Artificial Sequence
  Ly1484 short MHC HLA A2 class I binding peptide
RMFHSVKST

SEQ ID NO: 10921 - protein, 9 aa, Artificial Sequence
  Ly1484 short MHC HLA A2 class I binding peptide
SNFEYLMYL

SEQ ID NO: 10922 - protein, 9 aa, Artificial Sequence
  Ly1484 short MHC HLA A2 class I binding peptide
KVLMTFENL

SEQ ID NO: 10923 - protein, 9 aa, Artificial Sequence
  Ly1484 short MHC HLA A2 class I binding peptide
LLPPLWNRT

SEQ ID NO: 10924 - protein, 9 aa, Artificial Sequence
  Ly1484 short MHC HLA A2 class I binding peptide
QLFTKPHPA

SEQ ID NO: 10925 - protein, 9 aa, Artificial Sequence
  Ly1484 short MHC HLA A2 class I binding peptide
GAHLSLWNV

SEQ ID NO: 10926 - protein, 9 aa, Artificial Sequence
  Ly1484 short MHC HLA A2 class I binding peptide
WDLDHLTHV

SEQ ID NO: 10927 - protein, 9 aa, Artificial Sequence
  Ly1484 short MHC HLA A2 class I binding peptide
FISLHRKAL

SEQ ID NO: 10928 - protein, 9 aa, Artificial Sequence
  Ly1484 short MHC HLA A2 class I binding peptide
CILWDLDHL

SEQ ID NO: 10929 - protein, 9 aa, Artificial Sequence
  Ly1484 short MHC HLA A3 class I binding peptide
VLLPPLWNR

SEQ ID NO: 10930 - protein, 9 aa, Artificial Sequence
  Ly1484 short MHC HLA A3 class I binding peptide
CLGSYGSDK

SEQ ID NO: 10931 - protein, 9 aa, Artificial Sequence
  Ly1484 short MHC HLA A3 class I binding peptide
CVWELSMTK

SEQ ID NO: 10932 - protein, 9 aa, Artificial Sequence
  Ly1484 short MHC HLA A3 class I binding peptide
GLRLRQALY

SEQ ID NO: 10933 - protein, 9 aa, Artificial Sequence
  Ly1484 short MHC HLA A3 class I binding peptide
NLANPKIFR

SEQ ID NO: 10934 - protein, 9 aa, Artificial Sequence
  Ly1484 short MHC HLA A3 class I binding peptide
RVWKTEDVK

SEQ ID NO: 10935 - protein, 9 aa, Artificial Sequence
  Ly1484 short MHC HLA A3 class I binding peptide
QVPKQLFTK

SEQ ID NO: 10936 - protein, 9 aa, Artificial Sequence
  Ly1484 short MHC HLA A3 class I binding peptide
RMPPFTQAF

SEQ ID NO: 10937 - protein, 9 aa, Artificial Sequence
  Ly1484 short MHC HLA A3 class I binding peptide
KLKFIQRFK

SEQ ID NO: 10938 - protein, 9 aa, Artificial Sequence
  Ly1484 short MHC HLA A3 class I binding peptide
TILGFVSNF

SEQ ID NO: 10939 - protein, 9 aa, Artificial Sequence
  Ly1484 short MHC HLA A3 class I binding peptide
SLPGHPQPF

SEQ ID NO: 10940 - protein, 9 aa, Artificial Sequence
  Ly1484 short MHC HLA A3 class I binding peptide
WIDLIFGYK

SEQ ID NO: 10941 - protein, 9 aa, Artificial Sequence
  Ly1484 short MHC HLA A3 class I binding peptide
NLHHWIDLI

SEQ ID NO: 10942 - protein, 9 aa, Artificial Sequence
  Ly1484 short MHC HLA A3 class I binding peptide
YMQYPVFPW

SEQ ID NO: 10943 - protein, 9 aa, Artificial Sequence
  Ly1484 short MHC HLA A3 class I binding peptide
ELTPEFFYL

SEQ ID NO: 10944 - protein, 9 aa, Artificial Sequence
  Ly1484 short MHC HLA A3 class I binding peptide
ALYGHTQAV

SEQ ID NO: 10945 - protein, 9 aa, Artificial Sequence
  Ly1484 short MHC HLA A3 class I binding peptide
YLPEFLTNC

SEQ ID NO: 10946 - protein, 9 aa, Artificial Sequence
  Ly1484 short MHC HLA A3 class I binding peptide
IIVASYLVR

SEQ ID NO: 10947 - protein, 9 aa, Artificial Sequence
  Ly1484 short MHC HLA A3 class I binding peptide
DMTVQCHYY

SEQ ID NO: 10948 - protein, 9 aa, Artificial Sequence
  Ly1484 short MHC HLA A3 class I binding peptide
QLFTKPHPA

SEQ ID NO: 10949 - protein, 9 aa, Artificial Sequence
  Ly1484 short MHC HLA A24 class I binding peptide
QYPVFPWVL

SEQ ID NO: 10950 - protein, 9 aa, Artificial Sequence
  Ly1484 short MHC HLA A24 class I binding peptide
DYTSETLNL

SEQ ID NO: 10951 - protein, 9 aa, Artificial Sequence
  Ly1484 short MHC HLA A24 class I binding peptide
SYLVRMPPF

SEQ ID NO: 10952 - protein, 9 aa, Artificial Sequence
  Ly1484 short MHC HLA A24 class I binding peptide
YYTHYSSAI

SEQ ID NO: 10953 - protein, 9 aa, Artificial Sequence
  Ly1484 short MHC HLA A24 class I binding peptide
NFGQVPKQL

SEQ ID NO: 10954 - protein, 9 aa, Artificial Sequence
  Ly1484 short MHC HLA A24 class I binding peptide
SYGSDKVLM

SEQ ID NO: 10955 - protein, 9 aa, Artificial Sequence
  Ly1484 short MHC HLA A24 class I binding peptide
GFDDFSCCL

SEQ ID NO: 10956 - protein, 9 aa, Artificial Sequence
  Ly1484 short MHC HLA A24 class I binding peptide
EFFYLPEFL

SEQ ID NO: 10957 - protein, 9 aa, Artificial Sequence
  Ly1484 short MHC HLA A24 class I binding peptide
YFYGDRMDL

SEQ ID NO: 10958 - protein, 9 aa, Artificial Sequence
  Ly1484 short MHC HLA A24 class I binding peptide
RGLRLRQAL

SEQ ID NO: 10959 - protein, 9 aa, Artificial Sequence
  Ly1484 short MHC HLA A24 class I binding peptide
KNLALSREL

SEQ ID NO: 10960 - protein, 9 aa, Artificial Sequence
  Ly1484 short MHC HLA A24 class I binding peptide
KVLMTFENL

SEQ ID NO: 10961 - protein, 9 aa, Artificial Sequence
  Ly1484 short MHC HLA A24 class I binding peptide
TFSWGFDDF

SEQ ID NO: 10962 - protein, 9 aa, Artificial Sequence
  Ly1484 short MHC HLA A24 class I binding peptide
FYLPEFLTN

SEQ ID NO: 10963 - protein, 9 aa, Artificial Sequence
  Ly1484 short MHC HLA A24 class I binding peptide
ANPKIFRDL

SEQ ID NO: 10964 - protein, 9 aa, Artificial Sequence
  Ly1484 short MHC HLA A24 class I binding peptide
SFDVADRMF

SEQ ID NO: 10965 - protein, 9 aa, Artificial Sequence
  Ly1484 short MHC HLA A24 class I binding peptide
KTSPAVTAL

SEQ ID NO: 10966 - protein, 9 aa, Artificial Sequence
  Ly1484 short MHC HLA A24 class I binding peptide
KGRPRGLRL

SEQ ID NO: 10967 - protein, 9 aa, Artificial Sequence
  Ly1484 short MHC HLA A24 class I binding peptide
RNKVLLPPL

SEQ ID NO: 10968 - protein, 9 aa, Artificial Sequence
  Ly1484 short MHC HLA A24 class I binding peptide
EYLMYLNTA

SEQ ID NO: 10969 - protein, 694 aa, Homo sapiens
ELLKSIWYAFTALDVEKSGKVSKSQLKVLSHNLYTVLHIPHDPVALEEHFRDDDDGPVSSQGYMPYLNKYILDKVEEGAFVKEHFDELCWTLTAKKNYRADSNGNSMLSNQDAFRLWCLFNFLSEDKYPLIMVPDEGDEGNHPSPEPVPSTKHPNKTQDPPESPKQSVPKSCWGRLWEPDRALPGVGAGNTTCCSYQAFLLLLQVEYLLKKVLSSMSLEVSLGELEELLAQEAQVAQTTGGLSVWQFLELFNSGRCLRGVGRDTLSMAIHEVYQELIQDVLKQGYLWKRGHLRRNWAERWFQLQPSCLCYFGSEECKEKRGIIPLDAHCCVEVLPDRDGKRCMFCVKTANRTYEMSASDTRQRQEWTAAIQMAIRLQAEGKTSLHKDLKQKRREQREQRERRRAAKEEELLRLQQLQEEKERKLQELELLQEAQRQAERLLQEEEERRRSQHRELQQALEGQLREAEQARASMQAEMELKEEEAARQRQRIKELEEMQQRLQEALQLEVKARRDEESVRIAQTRLLEEEEEKLKQLMQLKEEQERYIERAQQEKEELQQEMAQQSRSLQQAQQQLEEVRQNRQRADEDVEAAQRKLRQASTNVKHWNVQMNRLMHPIEPGDKRPVTSSSFSGFQPPLLAHRDSSLKRLTRWGSQGNRTPSPNSNEQQKSLNGGDEAPAPASTPQEDKLDPAPEN

SEQ ID NO: 10970 - DNA, 2446 bp, Homo sapiens
gaactgctcaagtccatctggtacgcctttaccgcgctggacgtggagaagagtggcaaagtctccaagtcccagctcaaggtgctgtcccacaacctgtacacggtcctgcacatcccccatgaccccgtggccctggaggaacacttccgagatgatgatgacggccctgtgtccagccagggatacatgccctacctcaacaagtacatcctggacaaggtggaggagggggcttttgttaaagagcactttgatgagctgtgctggacgctgacggccaagaagaactatcgggcagatagcaacgggaacagtatgctctccaatcaggatgccttccgcctctggtgcctcttcaacttcctgtctgaggacaagtaccctctgatcatggttcctgatgagggtgatgaagggaaccacccgagccctgaaccagtgccctctactaaacacccaaacaagacccaggatcccccagaaagtcctaaacagagtgtcccaaaaagctgctggggcaggctctgggagccagatagagcactccctggtgttggtgctggcaacaccacctgctgcagctaccaggccttccttctcctgctccaggtggaatacctgctgaaaaaggtactcagcagcatgagcttggaggtgagcttgggtgagctggaggagcttctggcccaggaggcccaggtggcccagaccaccggggggctcagcgtctggcagttcctggagctcttcaattcgggccgctgcctgcggggcgtgggccgggacaccctcagcatggccatccacgaggtctaccaggagctcatccaagatgtcctgaagcagggctacctgtggaagcgagggcacctgagaaggaactgggccgaacgctggttccagctgcagcccagctgcctctgctactttgggagtgaagagtgcaaagagaaaaggggcattatcccgctggatgcacactgctgcgtggaggtgctgccagaccgcgacggaaagcgctgcatgttctgtgtgaagacagccaaccgcacgtatgagatgagcgcctcagacacgcgccagcgccaggagtggacagctgccatccagatggcgatccggctgcaggccgaggggaagacgtccctacacaaggacctgaagcagaaacggcgcgagcagcgggagcagcgggagcggcgccgggcggccaaggaagaggagctgctgcggctgcagcagctgcaggaggagaaggagcggaagctgcaggagctggagctgctgcaggaggcgcagcggcaggccgagcggctgctgcaggaggaggaggaacggcgccgcagccagcaccgcgagctgcagcaggcgctcgagggccaactgcgcgaggcggagcaggcccgggcctccatgcaggctgagatggagctgaaggaggaggaggctgcccggcagcggcagcgcatcaaggagctggaggagatgcagcagcggttgcaggaggccctgcaactagaggtgaaagctcggcgagatgaagaatctgtgcgaatcgctcagaccagactgctggaagaggaggaagagaagctgaagcagttgatgcagctgaaggaggagcaggagcgctacatcgaacgggcgcagcaggagaaggaagagctgcagcaggagatggcacagcagagccgctccctgcagcaggcccagcagcagctggaggaggtgcggcagaaccggcagagggctgacgaggatgtggaggctgcccagagaaaactgcgccaggccagcaccaacgtgaaacactggaatgtccagatgaaccggctgatgcatccaattgagcctggagataagcgtccggtcaccagcagctccttctcaggcttccagccccctctgcttgcccaccgtgactcctccctaaagcgcctgacccgctggggatcccagggcaacaggaccccctcgcccaacagcaatgagcagcagaagtccctcaatggtggggatgaggctcctgccccggcttccacccctcaggaagataaactggatccagcaccagaaaattagcctctcttagccccttgttcttcccaatgtcatatccaccaggacctggccacagctggcctgtgggtgatcccagctcttactaggagagggagctgaggtcctggtgccaggggcccaggccctccaaccataaacagtccaggatggaacctggttcacccttcataccagctccaagccccagaccatgggagctgtctgggatgttgatccttgagaacttggccctgtgctttagacccaaggacccgattcttgggctaggaaagagagaacaagcaagccggggctacctgcccccaggtggccaccaagttgtggaagcacatttctaaataaaaactgctcttagaatgaa

SEQ ID NO: 10971 - DNA, 476 bp, Homo sapiens
ggtgtgcattatgttggatgattgtaaattttcagtgcaaaatgtaccgtgtcctaaatttaaagacatgaaaaatatcccaagatcatactagatcataatagcaattcctttacaaatgaattatggaggtaactgatctctaacagtttccttcatgttgttttaatgcacaagggcagaggatctgctgacccttggaaccagcgtgactaaccacgtgctatagacacttcatggtgtcgcacccagggaagtcaaagcgctttgctccctcactgtctgtgagtcctcagccattagtaccccaccccccgctgctccaaaacttgagttatttcaaatgtttctcactgttcatctctccactgaccccactccagaaagcctggagagagtcccaagatgccacccaccttccccaatccctcgccacagatctgtgtctatctcacactctgtaagtgccgctttgc

SEQ ID NO: 10972 - DNA, 471 bp, Homo sapiens; identical to SEQ ID NO: 5023
  misc_feature (1)...(471): n = g, a, c or t

SEQ ID NO: 10973 - DNA, 379 bp, Homo sapiens; identical to SEQ ID NO: 657
  misc_feature (1)...(379): n = g, a, c or t

SEQ ID NO: 10974 - DNA, 240 bp, Homo sapiens; identical to SEQ ID NO: 617

SEQ ID NO: 10975 - DNA, 32 bp, Artificial Sequence
  PDM-797 PCR primer for His-Ly1452P
gtgtcacaatctacagtcaggcaggattctcc

SEQ ID NO: 10976 - DNA, 35 bp, Artificial Sequence
  PDM-799 PCR primer for His-Ly1452P
gttatgtagcggccgcttatcatgttgctgcagag

SEQ ID NO: 10977 - DNA, 22 bp, Artificial Sequence
  PDM-842 PCR primer for His-TCL-1
gccgagtgcccgacactcgggg

SEQ ID NO: 10978 - DNA, 31 bp, Artificial Sequence
  PDM-843 PCR primer for His-TCL-1
catttgaattcatcagtcatctggcagcagc

SEQ ID NO: 10979 - protein, 6 aa, Artificial Sequence
  6x His tag
HHHHHH
